United States Patent 11,446,398 (REGULATED BIOCIRCUIT SYSTEMS) - sequence listing, part 75

SEQ ID NO: 176452 - DNA, 453 bp, Homo sapiens
  Payload ID: 14638
  Gene Symbol: RPL21
  Gene Name: ribosomal protein L21
  ENST ID: ENST00000483765
  CDS Start-End: 13-192
taattcgccaaaatgacgaacacaaagggaaagaggagaggcacccgatatatgttctctaggccttttagaaaacatgggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaat

SEQ ID NO: 176453 - DNA, 2078 bp, Homo sapiens
  Payload ID: 14639
  Gene Symbol: RPL22
  Gene Name: ribosomal protein L22
  Uniprot ID: P35268
  ENST ID: ENST00000234875
  CDS Start-End: 40-426
cgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 176454 - DNA, 806 bp, Homo sapiens
  Payload ID: 14639
  Gene Symbol: RPL22
  Gene Name: ribosomal protein L22
  ENST ID: ENST00000465335
  CDS Start-End: 664-806
cgcgatcgccgccgcgcggccccgcgcgccaggcccctgcgctcaccagcaccgcctgctccagccgctcgcagccctgcacgtaagccgattccaggtccacgcagtgtgcccggctctccctgcagaaggcggcgggtgaggcccgctccagcggcccccagccccctcccctcgcgtcccctgtacgcacttctgcatgtcgcggaagcagcggatgcacaacagcaacttcttgtcggtggagaacaagaggcacttggcgctctgatatacccactttacagaggagggcactgcggctcagaggctggaatgttccaactgccacctccaggataaagaagcaagagtggatgacaccagacaggacaggagcaagcaggaagcaaagccccctattgatagagccaaaccgggatcagctggaaagcagaagtgtttgcagaggcccagcctgatcattatagagccaagaacagcagctggctttggagcttggtcaaccggcttgaggcctgagttgaaagctagacccatcagcacagtctcttctggtgattggacttttgctagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaag

SEQ ID NO: 176455 - DNA, 449 bp, Homo sapiens
  Payload ID: 14639
  Gene Symbol: RPL22
  Gene Name: ribosomal protein L22
  ENST ID: ENST00000484532
  CDS Start-End: 89-250
gaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggcggccagcactgggctgacccggcttctctatctacagcgtagttaaagcggatctgggagatggaggggttcccaacaccccagtctttggttccagaaggctggaccgacctctccttgcccagggatgaatgcagagggtcttttgtttggggtttgctggcaataaaattgaacgggaagaagggaaactgctgccgatcctgcgtgtctcag

SEQ ID NO: 176456 - DNA, 508 bp, Homo sapiens
  Payload ID: 14639
  Gene Symbol: RPL22
  Gene Name: ribosomal protein L22
  ENST ID: ENST00000465387
  CDS Start-End: 272-508
ggctccgcgtgaggcctcggctccaggggaggcacgtgggcctcgccgagcccggcatctacccaggctcgctggggacggcgccctgcagcgtcctgctggggtgggctggcaggtcggccggagcgggccagagcccctgccgatcccagcacgttgtaggcggaggaggccgcggcccgagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaatta

SEQ ID NO: 176457 - DNA, 524 bp, Homo sapiens
  Payload ID: 14639
  Gene Symbol: RPL22
  Gene Name: ribosomal protein L22
  ENST ID: ENST00000471204
  CDS Start-End: 257-524
ccgctccagcggcccccagccccctcccctcgcgtcccctgtacgcacttctgcatgtcgcggaagcagcggatgcacaacagcaacttcttgtcggtggagaacaagaggcacttggcgctctgatatacccactttacagaggagggcactgcggctcagaggctggaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaag

SEQ ID NO: 176458 - DNA, 600 bp, Homo sapiens
  Payload ID: 14639
  Gene Symbol: RPL22
  Gene Name: ribosomal protein L22
  ENST ID: ENST00000462296
  CDS Start-End: 455-600
attaactcatttaatctggagaacactcttaaaaagtagaaaatattaccccagaaagtggtggagctggtatacaaaaccgcgtaggtgctttgttaaggaatgatgcattagtttcccggtaggaggataaagaagcaagagtggatgacaccagacaggacaggagcaagcaggaagcaaagccccctattgatagagccaaaccgggatcagctggaaagcagaagtgtttgcagaggcccagcctgatcattatagagccaagaacagcagctggctttggagcttggtcaaccggcttgaggcctgagttgaaagctagacccatcagcacagtctcttctggtgattggacttttgctagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggta

SEQ ID NO: 176459 - DNA, 786 bp, Homo sapiens
  Payload ID: 14639
  Gene Symbol: RPL22
  Gene Name: ribosomal protein L22
  ENST ID: ENST00000497965
  CDS Start-End: 442-729
gctctgctagggctggtgtctctgaggagaaaacgaggctggttctgcaaatgttggaataagtgcagactggattccactgctgcttccagaatgttccaactgccacctccaggataaagaagcaagagtggatgacaccagacaggacaggagcaagcaggaagcaaagccccctattgatagagccaaaccgggatcagctggaaagcagaagtgtttgcagaggcccagcctgatcattatagagccaagaacagcagctggctttggagcttggtcaaccggcttgaggcctgagttgaaagctagacccatcagcacagtctcttctggtgattggacttttgctagaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaa

SEQ ID NO: 176460 - DNA, 2190 bp, Homo sapiens
  Payload ID: 14640
  Gene Symbol: RPL22L1
  Gene Name: ribosomal protein L22-like 1
  Uniprot ID: Q6P5R6
  ENST ID: ENST00000295830
  CDS Start-End: 317-685
ctcgcgtgcgtccgtatccgggagcagccactaggtaactgtagaggccactgcaattaatcggcttgaacagccaggagcggaaacccgagagtcagttcaaccacagccacccgcgtgtgcccgcggaaagccgatggcctactctcgtccggcagcgcactggtttcctgggttaccggcctcagcgctcctcccgctttcttttccgggaggcgacaatctgacgctctcagcgcgtgacgcagcacgctttgatataaatgcagaccgcgcggccgtagcttcctctctgctctcgcggccgactcgcaagatggcgccgcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaacttttgtctcatttttttgagtatgctgtttatatgattttgatttccctctgataactatcaacagtatttaaatagcttatagctggtataattttttcccacgatttccaaaatcttttatgtactcaggtaaaagtagcgttatataggaaatcttttttttagacactctcgttctgtcacccaggctggagtgcagtgactcagcttcctaaatagctggaattacaggtgtgagccaccatgcccggctaattttttgtacttttagtagagtagggtttggccatgttggccaggctggtttcaaactcctgacctcaagtgatctacccacctcggcttcccaaagtgctgattatagctgtgaaccaccatgcccggccaggaaatcttactgtagaacaattttttatatagctgtataaaatgtatatgattgtcttgacagtctcaaatactgtttttaatagcttgtaaatgtaatctcaagtgcttagaacagttcttacatataagttgctctgtagtttgctcttatagttagcccaaagactctgggtgtgaggcctgctgtaaaccaatgttaaactgcttattagaaagccctaaccacctgctttgtaggcaccagaaactcaaaaccaaatctcaactcagctacagaatctactgtggtccttgtctgaaaaaattagttcactcggttggaatcttgtctcagagcatcctcatctctttctcaaaagcccctaccccaacaccggcgtgttggttgtctattgaaacttacaagtggatggaccctttctcccgaataaactggcctttgaaagctctaatcgaaatggtttggcaaaatccatactgcaggagattagggaggacaagaatgatgtgcctttttgtactgctgagcctgatggtggtgccactacttcaggtacttagatgagtcttgatgctaatagaattgtgtcgccaaacatatctggacagttacaacctaatctatgcattaattggtttgggaattgcttgaaattattgtttaattcaatgttttaattcgttttcctaaaaatttaagtgcccccatcatcgtgcaatacctcagtgcagcaactccttgattcttggatgactgaacttcctaacttggctctgccccattgttcccatttttcatgtttttcacaaatagttaaccaggtacctactactgtgcaccgctgcagagcattgaggatgtatgtgatgagtaaaaacacccagcctgctctgctgtgttagtattatgacggaaactgatcaaatcacatgtgaacaaatttactgctacaaaagggagggcttaataaaaggaatttcatctgggaaggcaaa

SEQ ID NO: 176461 - DNA, 581 bp, Homo sapiens
  Payload ID: 14640
  Gene Symbol: RPL22L1
  Gene Name: ribosomal protein L22-like 1
  ENST ID: ENST00000475836
  CDS Start-End: 29-223
ctctctgctctcgcggccgactcgcaagatggcgccgcagaaagacaggaagcccaagaggtcaacctggaggtttaatttggaccttactcatccagtagaagatggaatttttgattctggaaattttggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaac

SEQ ID NO: 176462 - DNA, 506 bp, Homo sapiens
  Payload ID: 14640
  Gene Symbol: RPL22L1
  Gene Name: ribosomal protein L22-like 1
  ENST ID: ENST00000463836
  CDS Start-End: 29-394
ctctctgctctcgcggccgactcgcaagatggcgccgaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactct

SEQ ID NO: 176463 - DNA, 545 bp, Homo sapiens
  Payload ID: 14640
  Gene Symbol: RPL22L1
  Gene Name: ribosomal protein L22-like 1
  ENST ID: ENST00000466674
  CDS Start-End: 1-429
ggtcagaaacacaaccaagacgcgaggatcctgaactgtttttcgagactccctggcagctgccatgagcagaaagacaggaagcccaagaggtcaacctggaggtttaatttggaccttactcatccagtagaagatggaatttttgattctggaaattttgagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaa

SEQ ID NO: 176464 - DNA, 587 bp, Homo sapiens
  Payload ID: 14640
  Gene Symbol: RPL22L1
  Gene Name: ribosomal protein L22-like 1
  ENST ID: ENST00000494771
  CDS Start-End: 42-233
cggccgtagcttcctctctgctctcgcggccgactcgcaagatggcgccgaaagacaggaagcccaagaggtcaacctggaggtttaatttggaccttactcatccagtagaagatggaatttttgattctggaaattttggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactctt

SEQ ID NO: 176465 - DNA, 392 bp, Homo sapiens
  Payload ID: 14641
  Gene Symbol: RPL23
  Gene Name: ribosomal protein L23
  ENST ID: ENST00000378096
  CDS Start-End: 118-392
gtggccctaggcagctggggcgctttgctctccttcaggccggagagagagagccaggccaccgcgagagcactgccagggccctcgaaagtggcagtggggtgctggagagttgagatggcaggatcccgacgtgaatgtagacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcata

SEQ ID NO: 176466 - DNA, 625 bp, Homo sapiens
  Payload ID: 14641
  Gene Symbol: RPL23
  Gene Name: ribosomal protein L23
  Uniprot ID: P62829
  ENST ID: ENST00000394332
  CDS Start-End: 13-435
ccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttaca

SEQ ID NO: 176467 - DNA, 444 bp, Homo sapiens
  Payload ID: 14641
  Gene Symbol: RPL23
  Gene Name: ribosomal protein L23
  ENST ID: ENST00000394333
  CDS Start-End: 26-370
ttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtcttgctctgtcacacaggctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttaca

SEQ ID NO: 176468 - DNA, 2821 bp, Homo sapiens
  Payload ID: 14641
  Gene Symbol: RPL23
  Gene Name: ribosomal protein L23
  Uniprot ID: P62829
  ENST ID: ENST00000479035
  CDS Start-End: 134-556
aataaggcagcgcccagaggcggaagaggccggtttttgctccggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaaaactaaacccattaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctacagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtagatactgctcaatgactggctatacatggtagcttctcctggagtgaggaaggcattcaaatggctgggcgcggtagctggcacctgtaatcccaacactttcggaggccaaggcaggcagatcatgaggtcaggagttcaagaccaggctgaccaacgtggtgaaacctcctcttttctaaaaatacaaaaattagctgggcgtggtggcgcaccgcctgtaatctcagctactgagagaatcgcttgaacctgggaggtggagtttgcagcgagtcgagattgcaccattgtactccatccagcctgggcaacggagcaagattccgttcccgcccccgccccaaaaaaaggcattgaagttaagatagactatatagttagatcctggacacacacatggattttgaggaatgatgtgagtttgtttatgtatgtacattttagcagttaacagatttggagtaaattgaatatttataaaacaacagtaattgccatgtaggtttactgtcatagtggaagatgattaagttgatggtacctacaggtattttgctatgaaaatgttttgacaaacaggatgatcgtgtaatttatgttccaagctctagtttgagaatggaagaatgtggtaaatttttgccaactgaacaggcataaagcgctgataataagggacttggccttaaggtaggaggttgttagcatttctttctaaacgtgtaagagtttatttaggtgacacccagcgttttggaaaaatgggtgtttgtttagaacaataatttggagggaagtggactaaacagggtttttagattaaggtttgtgtttatgtatctgtatctgcaaatactcagccataaatgtttctacctgtaagttgggtataatacaagctccacttggtatcaaaaaggactacccttagtgtcttccatgactagttatggaatgtaccagacctagagaggagttgttctaacctggagcttttgaaaatgtttccggtccataccctagaccaattaagtcagactgcagaataggactcagacatcagaattgtgaagctcccaggagatgtcaaggtatacccaagactgagaaccagtaccctgtctagactgaaccaggcttggttttagaagtattaaatctcgcctgggtacggtggctcacacctataatcccagcactttgggaggctgaggtgggtggatcatctgaggtcaggagagtgagaccagcctgtccaacatgttgaaaccccatctctactatacaaaattagccaggcatggtggtgcatgctgtaatcccagctacttgggaggctgaggcaggagaattgcttgaaccccggagatggaggttgcagtgagctgaggtcgcacgattgtgctccagcctgggcaaccagtgaaactctggggggaaagaaaaaaaatgtattaaatctctagttttagagagttacaccataacatccctgagtatggtcaatttcaagtcagctttagtgtgacaagcccctaggcccaccatttatgtctttatatattatggcaatatatgatccttatatattaaccactaatcgctgctgtttttgaatgttatcttttctgaggcagtcttgctctgtcacacaggctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatattta

SEQ ID NO: 176469 - DNA, 615 bp, Homo sapiens
  Payload ID: 14641
  Gene Symbol: RPL23
  Gene Name: ribosomal protein L23
  ENST ID: ENST00000577407
  CDS Start-End: 28-396
ccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggtaggaaatcagtccagcttgttccttaggtctctgaggttgggtggattgtctagaagtacaggccaaggatcttctgtgtttgacgatgtcttaatctgtcccccacatgtttttattttattttattttatttttttaatgcaggttctgccattacaggaccagtagcaaaggagtgtgcagacttgtggccccggattgcatccaatgctggcagcattgcatgattctccagtatatttgta

SEQ ID NO: 176470 - DNA, 588 bp, Homo sapiens
  Payload ID: 14641
  Gene Symbol: RPL23
  Gene Name: ribosomal protein L23
  ENST ID: ENST00000245857
  CDS Start-End: 292-537
ctggattaggccctggtttgcgcgacctctgcggttttatgccttgcaggagtaattgcgttttgcgaaagttagagcaagggttgagtcgtctaggtttcttaatttcgatgtcagagtgttaatagacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaaaactaaacccattaaaaa

SEQ ID NO: 176471 - DNA, 333 bp, Homo sapiens
  Payload ID: 14641
  Gene Symbol: RPL23
  Gene Name: ribosomal protein L23
  ENST ID: ENST00000470646
  CDS Start-End: 231-333
attaggccctggtttgcgcgacctctgcggttttatgccttgcaggagtaattgcgttttgcgaaagacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcg

SEQ ID NO: 176472 - DNA, 587 bp, Homo sapiens
  Payload ID: 14642
  Gene Symbol: RPL23A
  Gene Name: ribosomal protein L23a
  ENST ID: ENST00000355731
  CDS Start-End: 1-476
cactggttggagctccatgtccccgggcctctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgac

SEQ ID NO: 176473 - DNA, 688 bp, Homo sapiens
  Payload ID: 14642
  Gene Symbol: RPL23A
  Gene Name: ribosomal protein L23a
  ENST ID: ENST00000394938
  CDS Start-End: 49-633
aggcatcatccgccagggagggccagacattcggttctgggaagctacatgcatccactggttggagctccatgtccccgggcctgtaaggaattagtgccctcagctttaaccattttccttctggttcatgttcaaccgggctacattacccgcccctctctccgcagcgtggttttgcgatgggctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 176474 - DNA, 1562 bp, Homo sapiens
  Payload ID: 14642
  Gene Symbol: RPL23A
  Gene Name: ribosomal protein L23a
  Uniprot ID: P62750
  ENST ID: ENST00000422514
  CDS Start-End: 614-1084
gttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccagagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggagta

SEQ ID NO: 176475 - DNA, 593 bp, Homo sapiens
  Payload ID: 14642
  Gene Symbol: RPL23A
  Gene Name: ribosomal protein L23a
  ENST ID: ENST00000578181
  CDS Start-End: 1-511
agctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaagtaagtttccttcctacaaaccccttaatgctcaccccttgggtgcaaatgatgcatatgttagcgaccaaagcctgatctttgctgattagtcataattaactgactgcacccctatccttgacaaaccttatcctcacattcctcattttgctttcta

SEQ ID NO: 176476 - DNA, 639 bp, Homo sapiens
  Payload ID: 14642
  Gene Symbol: RPL23A
  Gene Name: ribosomal protein L23a
  ENST ID: ENST00000472628
  CDS Start-End: 372-584
tttaatctcctgacacttgtgatgtcttcaaaggaaccactgatgcacctgtggccagggtggcccactgcagttcttggggccggaagtgaccgatttctaaatcccgcacccacgttttctttccttttctcccagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 176477 - DNA, 636 bp, Homo sapiens
  Payload ID: 14642
  Gene Symbol: RPL23A
  Gene Name: ribosomal protein L23a
  ENST ID: ENST00000496182
  CDS Start-End: 369-581
ccgcagagcgaacgaattgggaacacggctgctgggctaagccctgagggctctgctccggggctgctccctgcgtttcggacacgctgcagtatacgtgggccgcgtgggcccagcctcgtgggctgagttccgctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccata

SEQ ID NO: 176478 - DNA, 580 bp, Homo sapiens
  Payload ID: 14642
  Gene Symbol: RPL23A
  Gene Name: ribosomal protein L23a
  ENST ID: ENST00000394935
  CDS Start-End: 1-528
ggccagacattcggttctgggaagctacatgcatccactggttggagctccatgtccccgggcctcgtggttttgcgatgggctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcacc

SEQ ID NO: 176479 - DNA, 623 bp, Homo sapiens
  Payload ID: 14643
  Gene Symbol: RPL24
  Gene Name: ribosomal protein L24
  Uniprot ID: P83731
  ENST ID: ENST00000394077
  CDS Start-End: 107-580
ggggaggagatttccggcccccatccccgcagcgaccttataaggtctcttcccatgattctctctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataactct

SEQ ID NO: 176480 - DNA, 478 bp, Homo sapiens
  Payload ID: 14643
  Gene Symbol: RPL24
  Gene Name: ribosomal protein L24
  ENST ID: ENST00000495401
  CDS Start-End: 30-395
atcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcaggcacctacaaaggcagcacctaagcaaaagattgtgaagcctgtgaaagtttcagctccccgagttggtggaaaacgctaaactggcagattagatttttaaataaagattggattataa

SEQ ID NO: 176481 - DNA, 799 bp, Homo sapiens
  Payload ID: 14643
  Gene Symbol: RPL24
  Gene Name: ribosomal protein L24
  ENST ID: ENST00000469605
  CDS Start-End: 20-472
tttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggtaattatggggtttctttactttcttgaacaatacaacaggaaaattttctttttttgagacggagtcttgctctgttgcccaggatggggtgcagtggcgtgatctgatctcagctcactgcaacctctgcctcccgggttcaagtgatactcctgcctcagcctcccgagtagctgggagtacaggtgcgcgccatcacgcccggctgattttttgtttgtttgtttgtttgtttaagtagagacagggtttcaccatgtcggacaggctggtcttgaactcttgacctcaggtgatctgcccacctcagcctcccaaagtgctggggttacaagtgtgagccactgagcccggctggaaaatttattttcagtctaaattgtg

SEQ ID NO: 176482 - DNA, 524 bp, Homo sapiens
  Payload ID: 14644
  Gene Symbol: RPL26
  Gene Name: ribosomal protein L26
  Uniprot ID: P61254
  ENST ID: ENST00000293842
  CDS Start-End: 43-480
ctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagag

SEQ ID NO: 176483 - DNA, 328 bp, Homo sapiens
  Payload ID: 14644
  Gene Symbol: RPL26
  Gene Name: ribosomal protein L26
  ENST ID: ENST00000584441
  CDS Start-End: 1-192
gttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaagcttgggagtgtttttttcttatttttctgcaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgatt

SEQ ID NO: 176484 - DNA, 524 bp, Homo sapiens
  Payload ID: 14644
  Gene Symbol: RPL26
  Gene Name: ribosomal protein L26
  Uniprot ID: P61254
  ENST ID: ENST00000583011
  CDS Start-End: 86-523
accggaagcagcgtgtagttctcttcccttttgcggccatcaccgaagcgggagcggagtctttttaactttttatttagccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaa

SEQ ID NO: 176485 - DNA, 561 bp, Homo sapiens
  Payload ID: 14644
  Gene Symbol: RPL26
  Gene Name: ribosomal protein L26
  ENST ID: ENST00000584906
  CDS Start-End: 6-197
ccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggaggtttcaatgtttggtcattgaagaggcagttgaggaccagtaaacagaattgctcccaatctagattcaggagctgtaactgaagcacagtcacgttatcgtttgcacttacaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaa

SEQ ID NO: 176486 - DNA, 534 bp, Homo sapiens
  Payload ID: 14644
  Gene Symbol: RPL26
  Gene Name: ribosomal protein L26
  ENST ID: ENST00000583515
  CDS Start-End: 245-534
tttgatgcaaaagtctttagtccgtaaacatatacagaaaacacccgaataaaacaaaaaataaaaagtttcgagcttcggttgataggcccttccgatcaaacagtttttgttgaagttgcacaacatgacactgcctatgatcattctagactatcaagataaaatcattgcggttatttgtttggaagctggatgagattttggtcatttaagagtctttttaactttttatttagccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgt

SEQ ID NO: 176487 - DNA, 763 bp, Homo sapiens
  Payload ID: 14644
  Gene Symbol: RPL26
  Gene Name: ribosomal protein L26
  Uniprot ID: P61254
  ENST ID: ENST00000582556
  CDS Start-End: 311-748
gcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcgccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatac

SEQ ID NO: 176488 - DNA, 873 bp, Homo sapiens
  Payload ID: 14644
  Gene Symbol: RPL26
  Gene Name: ribosomal protein L26
  Uniprot ID: P61254
  ENST ID: ENST00000584164
  CDS Start-End: 393-830
agcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcggtaaagtcttcacggaatttccagaccacacttgcccactgggaggcttttaggacccgagacgtgtgcaggcttttccagccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 176489 - DNA, 1002 bp, Homo sapiens
  Payload ID: 14644
  Gene Symbol: RPL26
  Gene Name: ribosomal protein L26
  ENST ID: ENST00000578812
  CDS Start-End: 43-375
ctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtaggtgtttttgagaatgcttgagagaaggaaattatggcaattattgttgacatgattgtttacagagcaaggccatagaaatagtccttgattttacatgtgctggaaaaaaacattttaaagtaaatactactgcacttgtattgaaaattctaataccatttaaaatgtttctgacatcaaagtgttaacggtcattatgtttctgttagtttgtttttgagacagtcttgctctttcacccaggccggagtgcagtggcacaatctcggctcactgcagcctccacctcccaagtgcaagcgattctcccgcctcagcctcctgagtgtagctgtgactacatgcgtgcaccactacacccggctaatttttgtacttcttagtacaaagtttcaccatgttggccaggctggtcttgaactcctgacctcaggtgatttgcctgcctcagcctcctaaagtgctgggattacaggcatgagccaccatgcctgtcccattatgtatattgggcggaggttgcagtgagccgagatcgcaccattgcacttcagcctaggcaacgagtgaaaacgccatctcaaaaaaaaaaaaagaaaaaaaataaagaccttaactgatcttcccttacttctgacatctttt

SEQ ID NO: 176490 - DNA, 443 bp, Homo sapiens
  Payload ID: 14644
  Gene Symbol: RPL26
  Gene Name: ribosomal protein L26
  ENST ID: ENST00000582485
  CDS Start-End: 1-407
tgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagct

SEQ ID NO: 176491 - DNA, 747 bp, Homo sapiens
  Payload ID: 14644
  Gene Symbol: RPL26
  Gene Name: ribosomal protein L26
  ENST ID: ENST00000584343
  CDS Start-End: 425-747
ctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcggtaaagtcttcacggaatttccagaccacacttgcccactgggaggcttttaggacccgagacgtgtgcaggcttttccaggttcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactag

SEQ ID NO: 176492 - DNA, 722 bp, Homo sapiens
  Payload ID: 14645
  Gene Symbol: RPL26L1
  Gene Name: ribosomal protein L26-like 1
  Uniprot ID: Q9UNX3
  ENST ID: ENST00000265100
  CDS Start-End: 55-492
acttccggccctgcgcactcagggtctgaggcagctagtagccggagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaattccacatagtatttgcattgttttataaataaattccacttactatcaa

SEQ ID NO: 176493 - DNA, 695 bp, Homo sapiens
  Payload ID: 14645
  Gene Symbol: RPL26L1
  Gene Name: ribosomal protein L26-like 1
  Uniprot ID: Q9UNX3
  ENST ID: ENST00000519974
  CDS Start-End: 83-520
ggcgaacgaaacgcggagctcgggagcgacccggcggggccaggcacgggcagaagggccaagagggccacagagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgctt

SEQ ID NO: 176494 - DNA, 742 bp, Homo sapiens
  Payload ID: 14645
  Gene Symbol: RPL26L1
  Gene Name: ribosomal protein L26-like 1
  Uniprot ID: Q9UNX3
  ENST ID: ENST00000521476
  CDS Start-End: 125-562
cacgccgccggccgccgtttagtcccagagatagaaaaaagtagaggtaggagggcgcggcggctcacgcctgtaatcccagcactttggaaggccgaggcgggcggatcacgagagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcctaa

SEQ ID NO: 176495 - DNA, 233 bp, Homo sapiens
  Payload ID: 14645
  Gene Symbol: RPL26L1
  Gene Name: ribosomal protein L26-like 1
  ENST ID: ENST00000519522
  CDS Start-End: 118-233
accctgccctatgtgtcgcgggaacacatgtcaccccacagctctctttgagtgacctcccgaccacccattcctgcctaaccctagcattccttcctcagcctcaagagggtcaccatgaagttcaatcccttcgttacctcggaccgcagtaaaaaccgcaaacgtcacttcaatgccccctcacacgtgcgcaggaagatcatgtcatccccgctctccaaggagctgcg

SEQ ID NO: 176496 - DNA, 679 bp, Homo sapiens
  Payload ID: 14645
  Gene Symbol: RPL26L1
  Gene Name: ribosomal protein L26-like 1
  Uniprot ID: Q9UNX3
  ENST ID: ENST00000519239
  CDS Start-End: 65-502
agtagccgggtgagtggaggctggagttttctcggacagtgaactctaccgccccagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagttggaaaagagaaaggcaaatataaagaagaacttattgagaaaatgcaggaataaatagaacctgttgtgcaaccacggtttaaccggagattttgaggctagggtgtgtttctttcgaacttttcggaatgtctggaacatttcatttcctgttttgttacctgtgcctctgtaaatctacttttgcaattttaagtaataattttatgaataaaaatgggaaatgcttcc

SEQ ID NO: 176497 - DNA, 493 bp, Homo sapiens
  Payload ID: 14645
  Gene Symbol: RPL26L1
  Gene Name: ribosomal protein L26-like 1
  ENST ID: ENST00000519156
  CDS Start-End: 110-493
gtagagcctttgttgggggatgaggagtgtcttgggtcgagaacaggcccctgtaacccactgagcgccccttcattccgtctctctccgccctttgtagagggtcaccatgaagttcaatcccttcgttacctcggaccgcagtaaaaaccgcaaacgtcacttcaatgccccctcacacgtgcgcaggaagatcatgtcatccccgctctccaaggagctgcggcagaagtacaatgtccgctccatgcccatccgcaaggacgacgaggtccaggtagttcgaggacactacaaaggtcagcaaattggcaaggtagtccaggtgtacagaaagaaatatgtcatctacatcgagcgggtgcagcgtgagaaggccaacggcacaactgtccacgtgggcattcacccaagcaaggtggttatcaccaggctaaaactggacaaggatcggaaaaaaattcttgaacgcaaagccaagtctcgacaagtt

SEQ ID NO: 176498 - DNA, 490 bp, Homo sapiens
  Payload ID: 14646
  Gene Symbol: RPL27
  Gene Name: ribosomal protein L27
  Uniprot ID: P61353
  ENST ID: ENST00000253788
  CDS Start-End: 41-451
ctttcctttttgctggtagggccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaa

SEQ ID NO: 176499 - DNA, 697 bp, Homo sapiens
  Payload ID: 14646
  Gene Symbol: RPL27
  Gene Name: ribosomal protein L27
  Uniprot ID: P61353
  ENST ID: ENST00000589913
  CDS Start-End: 275-685
tagaagcttgggttgaatctttcaatccgctgccatccgcggcttgggggtcgaaggtccgggcggcgccgggtgcattccttccctaggtctctggcggctacgtatccgatcctgtcctgcgagcagggccctcgggcggccttgaccaaggcgacagtgaacacagtctgaagttccggcccaagacctgggcttgctggcaggagtcagctctgggcatctttggctttacggatttttaagtggccctttctccttgctctctgcagaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgtttt

SEQ ID NO: 176500 - DNA, 460 bp, Homo sapiens
  Payload ID: 14646
  Gene Symbol: RPL27
  Gene Name: ribosomal protein L27
  ENST ID: ENST00000586277
  CDS Start-End: 1-434
gacgcaaagctgtcatcgtgaaggtatcagcctcgcgggactctgcgtccttgcatgccgggaccaggctggctgcggcggggcgggcaggcttggaattcaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaatt

SEQ ID NO: 176501 - DNA, 585 bp, Homo sapiens
  Payload ID: 14646
  Gene Symbol: RPL27
  Gene Name: ribosomal protein L27
  Uniprot ID: P61353
  ENST ID: ENST00000589037
  CDS Start-End: 146-556
attcgaatacttgagctgccgcgccctgcgtttccctcatgagcttcttccgcccgcaacacgagactcagcaccacacaatcagcgtggcaaagcctgaagggcgggacaggaagtgaggtcactcctcaccggggtgaaagaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattata

SEQ ID NO: 176502 - DNA, 569 bp, Homo sapiens
  Payload ID: 14646
  Gene Symbol: RPL27
  Gene Name: ribosomal protein L27
  ENST ID: ENST00000590864
  CDS Start-End: 299-541
tctagtaagccgttccagatgcttcctgatggagataaacactgttctgtttctctttggtcatttctcatagctttctgtgatttttctctttataatggtggatcttggagacctgagggtggaaatattttttggacactgcactacctctaacacagggcctaaataggccctcagtgaataacaaatgtaattcttactcatttagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattat

SEQ ID NO: 176503 - DNA, 318 bp, Homo sapiens
  Payload ID: 14646
  Gene Symbol: RPL27
  Gene Name: ribosomal protein L27
  ENST ID: ENST00000588830
  CDS Start-End: 39-161
ttcctttttgctggtagggccgggtggttgctgccgaaatgggcaagttcatgaaacctgggaaggtggtgcttgtcctggctggacgctactccggacgcaaagctgtcatcgtgaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattataaagaaaaaaa

SEQ ID NO: 176504 - DNA, 4916 bp, Homo sapiens
  Payload ID: 14647
  Gene Symbol: RPL27A
  Gene Name: ribosomal protein L27a
  Uniprot ID: P46776
  ENST ID: ENST00000314138
  CDS Start-End: 404-850
cggctcagggctggcgcatttggtgaggagctcagacaacgaggcccttagggtcggcttaggcggttccctgaccaaggcgccagaaaagggcctggctcaagcaagcacgggcggcgtgcagtacagcacacctagccccgattcttcaacagttctcgccctccgagcctagcacaacgagcctcaccgaaaccgtacaccgccaccaggacactccgtgatgggggatcaccaccctcagaaagaggaagcgactagcaggcgcgcaatcccgcgagaccaggaggccccgcccgaagcccggcctctgtgaccggaagtgaggcgttttgccccgcccccgtggccgatacctcgcgagacttggcgaaggccttcctttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaacacagacgttggccagttaaacatttctgtttataaagtcagaataatacctgttgatcactgaaaggcctgcatgtattgtactctgaattttacagtgaatgagagaatgtaccctaattgttcaacagggctcaaaaggaaagattccattttgatgggtcacattctaaagaggggcagtgtgataggaatgagatggtcctttaggacttaagttctcagcccaaggtttttccacgtggccccctcatcttttttttttttttaaacggagtctctcttgccaggctggagtgcagtggcacgatctcggctcactgcagcctccgcctcccaggttaagcgattctcctgcctcagcttcctgactaactgggattacaggcgcccaccaccatgcccagctaatttttgtattttcagtagagatggggtttcaccatgttggccatgctggtctctaactcctaacctcaagtgatctgcccacatcggcctccaaaagttctgggattatagtgtgagccactgcgcccggccatggctccttaatcttgatccaaattattgttacatccagaatgtgatgaatcaaaatctcgagatgggggtccagcaatctgaaatttcagtatgccagggcttttctgtatgtcaaagtgggtttgaaatagttaatttttcttctagtctgaaatgtatcgggaaaatttggaaatcctgaaggctggaaattgaaataagtttttctaggatttgtgtctcttgctattggaaaactgatggtgaccaattcatgtttacaaataagatcctcatagatctcggtaaattataatttgctacagttttatggttcttcctgtgattttgagctttttttgacccaaaataatacagtctaaaactatagacaaataagatggcacttagactcctgggttttagttagtggaggtttccttagtgcactgtggggtcataataagccgagaaccatggctgtctatgggacacatctgtcaggacaacctttagaggatgttggggatcaaatagaaggcacagagaagcactgaattggcttacataagaataggctagaattacaagtagtgaaacctcgattcagctggacaattttaaacaaatgtatcatttggcttgtatcttctgttgtgctggagaagttagaaataagggctctccagaccagcctgaccaacctggagaaaccttgtctctactaaatacacaaaattagccaggcgtggtggcacatgcctgtaatcccagctactttggaggctgagccaggagaatctccaggaggcggaggttgctgtgagccgagatcgtgccattgcactccagcttgggcaacaagagtgaaactctgtccaccccccccaaaaaaagtaagggctctccattagggcccatagaggacttgtaatatggaacctgaatccaaggatcccacaataagtggtcagtagttcatgatgaattaaaagactcaatatttggtcttcacccaatacctgtgtgacttttagtcctaatttcctcatctttaaaatttcagtgaaagtgcctacctgaggattgtgtagattaaaatggaaaccgtgcacttaattttttgttttgttttgagacggagtctcgctctgtcgcccaggctggagtgcagtggtgcgatctcagatcactgcaagctccgcctcctaggttcagaccattctcctgcctcagcttcccaagtagctgggactacaggcgcccgccactgcgcccggctaattttttgcatttttagtagagacagggtttcaccgtgttagccaggatggtctcgatctcctgatctgcccgcctcagcctcccaaagtgctgggattacaggcatgagccaccgcgcccggcccaggcacttaatttttgtgtttgacttagtaacttaagtgcaaactattacgggagcagatggagtcaattggccttcatgtgattgtcagtgggaaattggtccaagcagagggaatactggttcaggaaactggtttgggaaggttaggcaaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaagtagagtttggggggaaggatccctagtcccttaatggctaccttcttccccaggagttgttaggccatccgatcccctggcctgggaaagaaacactgatttcgttgctggcttgttcactcaccagaagctacagctactaacagttctaaaaactgtttcatgtgatgaggaacagacgaaaatagttttgagccctaagtccgccgattccagtgctttcttgaacccgcatttactaaaatattttcatgactgccaagctttgaatagcctgctgtgttcatggaggctcatactggcgatctctagtggctggctaaagcttgaattgcaaaagatctaatttctggtctaatgtatatatgccttaaatatagttgcgttcaaacgtgggagctgcaggtgcaacttgattttatgacaaatggctgccacataatttgcacaagcagtgctcgtcaagggcagctaaatcaggcgagctttcaatcaaaataaatgtactactaaaccctacttagcggctaactagcccaagagcagacagcccacggacggactgcaagtcggaagcgcgggcggaagctgtgcagcgcccacctggtggctccatcggccgcgttcatcagtcagcacgacccgacctcagtggcgtcctcacaacacagaccggaccttgggtcttaccccggcacctgagaaccacttccggtgagtagcttctacttccggagacgatgactcccccgcgtcccagaccggaagaagcccggcggagaccggcctcgctcggccacttccggcaagggcggagccggccagtggtgcgcgagcgcagataactcccctggagaggcgggatgttcaactccacccctggtccttgggcggccgtgggtccccttcgaagcggaggaatggccaacctcgccgcacttcgagcccctttagggtgcgtttaagaacagtgggcgtggcctttacgtaaatcttcgagatgggaacctccagaatttgtctcaattgtctaaaaggtaatgagcgtcagcgacattcaagggcactttgggctaaaaaagaaagtgcttgtacacggatggaaatattctagaagaacataaaaggaatttcctcttaggaggttagggaaatgagcacgaagtatgttttggtgcagttttttgttcaacccaatgcgtattttcatattgagaggcaatataaatggagcgaaagtatcttgagaaaaaaaaaaaaactaccagaacttgccgttgctgaaaagtaatattttctctttcgagagttttcatggccttttaaattacacccccacctccacaggcaaataaatttgttttggaatgcataccacatcatctggctctagaaacgtattttgtgtagctcccctagcaagaatataggttaaagcgtaaatttaattcctggctctattttacatcccaatttttattttcctctcattcccactttacgttgtttcaaataacctagtttgtgtatccctgtaagtcattttggtataaagtaggttataagtgtacatgcgaaaagatgtttttaacaaaaatgtaactga

SEQ ID NO: 176505 - DNA, 519 bp, Homo sapiens
  Payload ID: 14647
  Gene Symbol: RPL27A
  Gene Name: ribosomal protein L27a
  ENST ID: ENST00000526562
  CDS Start-End: 202-477
gccatccagactgaggaagacccggaaacttaggggccacgtgagccacggccacggccgcataggcaagcaccggaagcaccccggcggccgcggtaatgctggtggtctgcatcaccaccggatcaacttcgacaaatatgtgtatgaaggtggttgttacctcttcctagccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttc

SEQ ID NO: 176506 - DNA, 558 bp, Homo sapiens
  Payload ID: 14647
  Gene Symbol: RPL27A
  Gene Name: ribosomal protein L27a
  ENST ID: ENST00000524496
  CDS Start-End: 242-517
ttcctttttcgtctgggctgccaacatgccatccagactgaggaagacccggaaacttaggggccacgtgagccacggccacggccgcataggcatgagccatcacaccggccccacgtagctttgtattcctgcaggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactacttttt

SEQ ID NO: 176507 - DNA, 878 bp, Homo sapiens
  Payload ID: 14647
  Gene Symbol: RPL27A
  Gene Name: ribosomal protein L27a
  ENST ID: ENST00000530022
  CDS Start-End: 561-836
caacatggtaggtgtttcgtttcttgcctcctcttccttgccggcggagacccctaagctgtattcccattgcccctagtcatccactccctaccatggtcggggcttccaggctgcgcatggccgcctgcggggcagggtggccggcgcgggcccggggcggggctcccggagccgtgtgttaggcccgcggttcggatctctaggacacgcgggcccctgcgctaccgtggtgagacctcacggccctgagcggatcggtaccctcagctttcccaaacgctccagaagttaggtctttgacccacaggcttacaggaccatctcggctggcgggcatcgccccctgcccctaattccttaggccttaccaccaagctttttccacacagccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttc

SEQ ID NO: 176508 - DNA, 867 bp, Homo sapiens
  Payload ID: 14647
  Gene Symbol: RPL27A
  Gene Name: ribosomal protein L27a
  ENST ID: ENST00000531978
  CDS Start-End: 27-353
cttcctttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcggtaagttaattggatgtttttctgtacttccataccttcccttacaaaactctggcttaatctaatccacttatataatctgtacttcccagttacctaccagacattgatattcttcctgtggtagaattatcataggtagttccctatccgtagcagtgcctactgtcactgcccaggttgtatcaggtttgcatttcgtgcttgaactatagctggttttcactgagcacagctcttggcccttcatgttctccagataatagaatcctaatatgttccattgatactcagtgccatgcattatctgaagagattttcccccaaaacagatgtattatgtctgtccttgcgggggttctggtccctgtgtcagtcttaactctcatgaatatagaggtagtgttaagaggccagaaccctagggacgctttaaattcacttcccagcctatttaatgtccattgagtagttctggtggtcaggaaggtggttgtcttcttttgcttagcagggggtattt

SEQ ID NO: 176509 - DNA, 805 bp, Homo sapiens
  Payload ID: 14647
  Gene Symbol: RPL27A
  Gene Name: ribosomal protein L27a
  ENST ID: ENST00000530913
  CDS Start-End: 488-763
attgcctgagtgtgctagagtcctcgaagagtaactgctgaccttattcactggctgtgggccttatggcacagtcagtcaccaggttagagacatgcttcacattcacctacccacaaactagtggatgataaattttggctattcagaagacgtttattataggagtatgtagattttccatagagtgctgttatgtgacttgaattttagtctcggccctgcctctgacattgtcggtggtttatcctggttccaggaaataagactagccttttcctcatgatagtctttggtggtttttaaaacagttgtttaagtcaacagatgtatcatatgcctgacactgctctacaccagtgaataatttacactctaatagggggtggtaactataaagatgataaacatagcatcttaattggagtgtgtatgaaggtggttgttacctcttcctagccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttc

SEQ ID NO: 176510 - DNA, 406 bp, Homo sapiens
  Payload ID: 14647
  Gene Symbol: RPL27A
  Gene Name: ribosomal protein L27a
  ENST ID: ENST00000532359
  CDS Start-End: 23-364
ctttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaatatgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttc

SEQ ID NO: 176511 - DNA, 651 bp, Homo sapiens
  Payload ID: 14647
  Gene Symbol: RPL27A
  Gene Name: ribosomal protein L27a
  ENST ID: ENST00000534599
  CDS Start-End: 23-148
ctttttcgtctgggctgccaacatgccatccagactgaggaagacccggaaacttaggggccacgtgagccacggccacggccgcatagtagagtcgggggtttctccgtgttggccaggctggtctcgaactcctgacctcaggtgatctaccccccctcgtcctcctaaaatgctgggattacaggcatgagccatcacaccggccccacgtagctttgtattcctgcaggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactacttt

SEQ ID NO: 176512 - DNA, 297 bp, Homo sapiens
  Payload ID: 14647
  Gene Symbol: RPL27A
  Gene Name: ribosomal protein L27a
  ENST ID: ENST00000525981
  CDS Start-End: 1-128
ggaagacccggaaacttaggggccacgtgagccacggccacggccgcataggcaagcaccggaagcaccccggcggccgcggtaatgctggtggtctgcatcaccaccggatcaacttcgacaaataggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactacttttt

SEQ ID NO: 176513 - DNA, 4796 bp, Homo sapiens
  Payload ID: 14648
  Gene Symbol: RPL28
  Gene Name: ribosomal protein L28
  Uniprot ID: P46779
  ENST ID: ENST00000344063
  CDS Start-End: 630-1043
gggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattttcggcggaagcagccgaacatcatcgagccgcctcggaggtggggaccgacaactcctgtcgtgcccgcccggagaggaagcggaaatgcgtgtacggtattaaaggcgtcgcctcgcccctcgccttcctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagaaggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcagcctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaa

SEQ ID NO: 176514 - DNA, 573 bp, Homo sapiens
  Payload ID: 14648
  Gene Symbol: RPL28
  Gene Name: ribosomal protein L28
  Uniprot ID: P46779
  ENST ID: ENST00000428193
  CDS Start-End: 43-252
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccgagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattg

SEQ ID NO: 176515 - DNA, 590 bp, Homo sapiens
  Payload ID: 14648
  Gene Symbol: RPL28
  Gene Name: ribosomal protein L28
  Uniprot ID: P46779
  ENST ID: ENST00000431533
  CDS Start-End: 43-306
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagatt

SEQ ID NO: 176516 - DNA, 670 bp, Homo sapiens
  Payload ID: 14648
  Gene Symbol: RPL28
  Gene Name: ribosomal protein L28
  ENST ID: ENST00000560055
  CDS Start-End: 39-551
ttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatgcttgcgggaagggttgggaggcagcaggctgtaagcagcctggagcaccagcctagaccaggacgcctccacctcagcaacaccgcagccaggtcattctgtgtcatggagccatctcgtacgctgcaggatttgggcagcacccttggcctccacccactagatgctagtggcacccccgagttgtgacaaccctttctggtctcctgacaatgcataataccccttggggggcaaaatcacctctggctgagaaacactggtttatgaaccctatcgctattaaaaaaccactgaactgtatactt

SEQ ID NO: 176517 - DNA, 616 bp, Homo sapiens
  Payload ID: 14648
  Gene Symbol: RPL28
  Gene Name: ribosomal protein L28
  Uniprot ID: P46779
  ENST ID: ENST00000558815
  CDS Start-End: 43-552
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcatgatcacagatg

SEQ ID NO: 176518 - DNA, 1204 bp, Homo sapiens
  Payload ID: 14648
  Gene Symbol: RPL28
  Gene Name: ribosomal protein L28
  Uniprot ID: P46779
  ENST ID: ENST00000560583
  CDS Start-End: 41-532
ctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtgg

SEQ ID NO: 176519 - DNA, 444 bp, Homo sapiens
  Payload ID: 14648
  Gene Symbol: RPL28
  Gene Name: ribosomal protein L28
  ENST ID: ENST00000558131
  CDS Start-End: 9-278
ccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctca

SEQ ID NO: 176520 - DNA, 852 bp, Homo sapiens
  Payload ID: 14648
  Gene Symbol: RPL28
  Gene Name: ribosomal protein L28
  Uniprot ID: P46779
  ENST ID: ENST00000559463
  CDS Start-End: 398-811
gggaggtgagcgttcgtcttcctcgcgtggtcgccatctccggcccgccgcgcactccctctcagtcctctgcctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgctctcttcctctgctgtccgagcgtggcccgtggcctaacgctgctttagttctctgtgtctgacgctttccctgtgcccgtttccccgcagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctca

SEQ ID NO: 176521 - DNA, 671 bp, Homo sapiens
  Payload ID: 14648
  Gene Symbol: RPL28
  Gene Name: ribosomal protein L28
  ENST ID: ENST00000558752
  CDS Start-End: 2-340
catgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaa

SEQ ID NO: 176522 - DNA, 723 bp, Homo sapiens
  Payload ID: 14649
  Gene Symbol: RPL29
  Gene Name: ribosomal protein L29
  Uniprot ID: P47914
  ENST ID: ENST00000294189
  CDS Start-End: 95-574
ttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcaggatttgttagcctctgtctatgatcctggg

SEQ ID NO: 176523 - DNA, 551 bp, Homo sapiens
  Payload ID: 14649
  Gene Symbol: RPL29
  Gene Name: ribosomal protein L29
  Uniprot ID: P47914
  ENST ID: ENST00000475248
  CDS Start-End: 46-525
acgggtggcggcggggcgcgggctgcggagaggactggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaa

SEQ ID NO: 176524 - DNA, 670 bp, Homo sapiens
  Payload ID: 14649
  Gene Symbol: RPL29
  Gene Name: ribosomal protein L29
  Uniprot ID: P47914
  ENST ID: ENST00000479017
  CDS Start-End: 71-550
tgccatccgcgacttacgggtggcggcggggcgcgggctgcggagaggactggtgaccgaccgtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagg

SEQ ID NO: 176525 - DNA, 537 bp, Homo sapiens
  Payload ID: 14649
  Gene Symbol: RPL29
  Gene Name: ribosomal protein L29
  Uniprot ID: P47914
  ENST ID: ENST00000492277
  CDS Start-End: 59-537
cgggtggcggcggggcgcgggctgcggagaggactggtgaccgaccgtgtgtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagta

SEQ ID NO: 176526 - DNA, 880 bp, Homo sapiens
  Payload ID: 14649
  Gene Symbol: RPL29
  Gene Name: ribosomal protein L29
  ENST ID: ENST00000481629
  CDS Start-End: 34-216
ggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtgagtgcactgaatcacatggaagtgtcttttcttggttccaggtgcacagtcaaggcctctcatgtagtttttctctagctttggcttctgcctgagcacagcctaactggcccacccaaagcctgcaattcctttttctaccctaccagacccataataaagctttccttggtctccacagcctgaagtgtaaccctctggtcagggtgtaacctgcctcctgagggcagtttggctatctcccttgcttggcagtggcacttagggtaaggagtggccttgtctgagtgcgtgcagggcacattcccacactgaccagccttatgacctccatctgacccagtgctggagttggggtcagcttctcttcctgtgtcagggggttctaaggattagctgagaaggctggagggtctaggggagagctgagcatgtccccagtctgttccttccctttacttttgctctctgttccgtggagtgaatcacaaactctgagcctcagtttccccatatcccaccttggctataagtcttttggaccagacttggtatttaattgacaccttcttctaaagaggggagggggtgtccctgaggggatgtcaggaaaaaacttggtcgaacccctgctgtaggaagttgaagccccacaaccttggcagacagggcagcaaagcagcttgtaattttgttcttgaaggaggtctgcacagcattacccaggtggcgtattggctcc

SEQ ID NO: 176527 - DNA, 742 bp, Homo sapiens
  Payload ID: 14649
  Gene Symbol: RPL29
  Gene Name: ribosomal protein L29
  Uniprot ID: P47914
  ENST ID: ENST00000466397
  CDS Start-End: 142-621
gcttatggtgagtgttggccgcgcggcatccgatgccatccgcgacttacgggtggcggcggggcgcgggctgcggagaggactggtgaccgaccgtgtgtctgtcgggagcaaaagctgcggggtgggaatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 176528 - DNA, 719 bp, Homo sapiens
  Payload ID: 14649
  Gene Symbol: RPL29
  Gene Name: ribosomal protein L29
  ENST ID: ENST00000480306
  CDS Start-End: 34-147
ggcgcttcgggagccgcggcttatggtgcagacatggccaagtccaagaaccacaccacacacaaccagtcccgaaaatggcacagaaatggtatcaagaaaccccgatcacaaagatacgaatctcttaaggggcctgaagtgtaaccctctggtcagggtgtaacctgcctcctgagggcagtttggctatctcccttgcttggcagtggcacttagggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 176529 - DNA, 713 bp, Homo sapiens
  Payload ID: 14649
  Gene Symbol: RPL29
  Gene Name: ribosomal protein L29
  Uniprot ID: P47914
  ENST ID: ENST00000495383
  CDS Start-End: 114-593
cgcgcggcatccgatgccatccgcgacttacgggtggcggcggggcgcgggctgcggagaggactggtgaccgaccgtgtgtctgtcgggagcaaaagctgcggggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagg

SEQ ID NO: 176530 - DNA, 1442 bp, Homo sapiens
  Payload ID: 14650
  Gene Symbol: RPL3
  Gene Name: ribosomal protein L3
  Uniprot ID: P39023
  ENST ID: ENST00000216146
  CDS Start-End: 175-1386
gaacgaaagctaggagcggaagagcgtgcgtggaaatggcgctcggtacgtgcccccgacctgtcgtctgccgcgggggcgcgctcgcacgccggaaggggcggggccagatttggctttatatagcggacccgtaaggccgaccggcctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactga

SEQ ID NO: 176531 - DNA, 1205 bp, Homo sapiens
  Payload ID: 14650
  Gene Symbol: RPL3
  Gene Name: ribosomal protein L3
  ENST ID: ENST00000402527
  CDS Start-End: 388-1205
ctctaccggcgggatttgatggcgtgatggtatgtgttgtaatggcggccgtttcattgtcaccggcgtcggcacggctgaatccgcgacgcatcgccgccatcccgtcttggccggcgccgggggtttgctttaggggcacgggcgacccagcggggacttcagtctggcctattttctggaaagtcgagaggcttgtgaagagcgcttggaggactggctttgggcctgcagtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtga

SEQ ID NO: 176532 - DNA, 1289 bp, Homo sapiens
  Payload ID: 14650
  Gene Symbol: RPL3
  Gene Name: ribosomal protein L3
  ENST ID: ENST00000401609
  CDS Start-End: 176-1231
cggtgatttttttcccacctagtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaca

SEQ ID NO: 176533 - DNA, 782 bp, Homo sapiens
  Payload ID: 14650
  Gene Symbol: RPL3
  Gene Name: ribosomal protein L3
  ENST ID: ENST00000427905
  CDS Start-End: 1-782
ggtatgtgttgtaatggcggccgtttcattgtcaccggcgtcggcacggctgaatccgcgacgcatcgccgccatcccgtcttggccggcgccggggtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaag

SEQ ID NO: 176534 - DNA, 916 bp, Homo sapiens
  Payload ID: 14650
  Gene Symbol: RPL3
  Gene Name: ribosomal protein L3
  ENST ID: ENST00000453303
  CDS Start-End: 1-916
cagatgatgaacttattgacgggcggacagaaactgtgtgctgattgtcacgttctgatttggctctgcggagttctttggccttctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactg

SEQ ID NO: 176535 - DNA, 711 bp, Homo sapiens
  Payload ID: 14650
  Gene Symbol: RPL3
  Gene Name: ribosomal protein L3
  ENST ID: ENST00000420536
  CDS Start-End: 27-569
ctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattgctccgctcggctctgcccgatgagctccatccaggctccgcttgctggtggaaaaggctccttagaagccggcaatgagctccatccccacgcggtgccagtgtgccttccgctcacccctcggaggggtgatgaaggcctgcacctggtcccctccccaactctgctctgctcctgaaggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgc

SEQ ID NO: 176536 - DNA, 543 bp, Homo sapiens
  Payload ID: 14651
  Gene Symbol: RPL30
  Gene Name: ribosomal protein L30
  Uniprot ID: P62888
  ENST ID: ENST00000287038
  CDS Start-End: 116-463
agttccggctctgccgtgaagagctttgcattgtgggaagtctttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 176537 - DNA, 440 bp, Homo sapiens
  Payload ID: 14651
  Gene Symbol: RPL30
  Gene Name: ribosomal protein L30
  ENST ID: ENST00000396070
  CDS Start-End: 70-360
ctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 176538 - DNA, 575 bp, Homo sapiens
  Payload ID: 14651
  Gene Symbol: RPL30
  Gene Name: ribosomal protein L30
  Uniprot ID: P62888
  ENST ID: ENST00000521291
  CDS Start-End: 148-495
gctgttggtgagtgggctcctaccgaccgaggtttaggcagcgcggggagctttgcgggttgccatttgtaactccggatcctaaaattcctgtcctgttctctgtctcttctaggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 176539 - DNA, 1129 bp, Homo sapiens
  Payload ID: 14651
  Gene Symbol: RPL30
  Gene Name: ribosomal protein L30
  ENST ID: ENST00000521726
  CDS Start-End: 788-1129
ttttaaaaaattagacctgtttatcgcgctctcagtgcaaactcggctcacaagttcacgctaacacagtcacaaaaggcgagttttgggaaactcgagcagggcgccaccgttctccaggggacaggtaacttgggtgaccgcaggggtgaggacacagctgcttctaccaagcggagagtaaatgcgggtgctgcggcgcatcggagtcacccacaaggctctccaagagccgcgcctcaggacaaagatgaattcagcggcattgagaccgtggtcgcagccgccgcagcctcttctcatctaccctcccacctcaccttcagtcggcttttcgaactccctccgggttctaagcgcctcgattagttagaccgcagctcgcagcagaacagcaacacaacgccgcgaagcttaaaggcccgcagagggggaaaagaacacccccgccgtcattcttttttttccttctttgagacagagtctcactctgtcgcccaggctgagtgcagtggcgcgatcatggctcactgcagcctcgacctaccgagctcaagcgacctctccgcctcagcctccggcgtagctgggagtagctaggactactggagcgcgccaccacgcccggctaatttcttttttatttcttttttatttttttgtagagacaggggtggtctatgttgtccaggctggccttgagctggacgcaacagatcttcccgcctcaacctccgaaagtgctgggattaaaggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaa

SEQ ID NO: 176540 - DNA, 274 bp, Homo sapiens
  Payload ID: 14651
  Gene Symbol: RPL30
  Gene Name: ribosomal protein L30
  ENST ID: ENST00000523172
  CDS Start-End: 118-273
tcctttctcgttccccggccatcttagcggctgctgttggttgggggccgtcccgctcctaaggcaggaagatggtggccgcaaagaagacggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaa

SEQ ID NO: 176541 - DNA, 614 bp, Homo sapiens
  Payload ID: 14651
  Gene Symbol: RPL30
  Gene Name: ribosomal protein L30
  ENST ID: ENST00000518850
  CDS Start-End: 71-241
cctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgggcttcgcctaccgcgaattcatcgtgaacgaatatacaggagtgtaaacttgtaatctgagtaccatgaactcgaacacttgcaggataattacggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 176542 - DNA, 1865 bp, Homo sapiens
  Payload ID: 14652
  Gene Symbol: RPL31
  Gene Name: ribosomal protein L31
  Uniprot ID: P62899
  ENST ID: ENST00000264258
  CDS Start-End: 602-979
ctcagatctccctgtcgtgtcatctcacatctgtcatctctcaggtcatatccaacacactgggccacccacgcacagggacgacgcgacagccctgtggctccaccgcacaggacagccacgactggcaatcctgtgccggccctgctcgacgcaagcacctccagcgccgggttgcgtcttagtgaccctgggaccgccagccaggcaccgcgcccgacgcaggctcagtcagtgttggtcggatgcatgaatgaatgggaaaaacgaagtctctctctccctggccctgctcccatacatctgtaggcctaggtcttggttttatccgaagacttagagaagggacgcaagttccttcgcggagccagaaggaatccgtcgagaagcgggacctcaagctcgcggcccaaaagcgcggccccgccacgacgcctgctagctggccccacttcggcgcgcgccgcttacatcatagctcgcctctccccttccctagccacacccccttgcctggcgacccggaagttgtacttgcaactgcggctttccttctcccacaatccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgccttcatgtttttgttctttttagttgcaacataatgtacttgtataccctatcctaattatgggatcatttgaagagcttttcccaaattgatggcctgtgctgccttctccccatcccctggggttttaaagtgatttcaaactgcaacctagttttagaaccactgttctgggtagttgggatactgaaggcatattgttaattattctacttgtatgttttgctaattctaagataagcatttttccagaaaccaggatgtagaatccagttgccattgacatcttaacattttaggaaacaactttaaaatgatatactatctatctatctatctgtagcatcttaaaggtaatgaaattaatgtggcagtaggtcttttaagcttctgcctacatccatattgagtatagttgttgtcttctaaaataattaattgatttttggtgagataaccagattcatattttaagccttttgtaatggccccgtggtacctggagtcaaggttcagaagtaaaaagttccttaaggtatcaataacaaaaatttgtattaatagttcagtcctaaagcagtgttgctgagattatgtttcaccagcatttacaagctgtatgttaaatgctgccataaagaggtctctgaagccgtagggcacacccaaggcagggctgagaagtacctagtagtgttgcaccacccaaaaaccatggatgggcagcagcaacatctccagcttacccattcactgccacagtctacagcttaagacacttaactacaaggtaaaagaaaaggaccaagtaaatacaaaaagtttcttattaaaaaacttggaagccaa

SEQ ID NO: 176543 - DNA, 770 bp, Homo sapiens
  Payload ID: 14652
  Gene Symbol: RPL31
  Gene Name: ribosomal protein L31
  ENST ID: ENST00000409650
  CDS Start-End: 24-386
ctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaattgtcaccatcagtgagaaaccgaacaagaagaggaaagcaaatggcattttcttctctacttggtgaaaagtcattatagaggattcgaacggttccaatgctcgcaattctacttcaagcatgtgctcattctacatatcaacccctttttcactgacaaatgtaatgttgacaatctaggctaatgggactagattttgaatccaatcaacactttttcatataaagttttcagaataacaaagctttccctcattcatacagatattgctgtactaatctataattatgttttagaattcaaattataacactgactaaacatcactaatgaaacatttgtgacctccttttttccgaagtttaatttttgctttgaattcatattttatcagtat

SEQ ID NO: 176544 - DNA, 825 bp, Homo sapiens
  Payload ID: 14652
  Gene Symbol: RPL31
  Gene Name: ribosomal protein L31
  Uniprot ID: P62899
  ENST ID: ENST00000409733
  CDS Start-End: 410-787
ctttccaacttggacgctgcagagtgagtatgggtggcggagtctgggctcctggaatccagccccatcctcctttgggattgtgctaactgggaccgcaaaatctctcccgagccagcccggggctccggttgtggggagatgggaatacaccctgcttttaaaggctcccagagcctgaggaagaaagtgaccaggcttaggggagccggagcggcagggatttccgggtcggaggcatctgaggggcgcaggggcgcgggtgcgtgggccactgggtgaccgacttagcctggccagactctcagcacctggaagcgccccgagagtgacagcgtgaggctgggagggaggacttggcttgagcttgttaaactctgctctgagcctccttgtcgcctgcatttagatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcc

SEQ ID NO: 176545 - DNA, 1110 bp, Homo sapiens
  Payload ID: 14652
  Gene Symbol: RPL31
  Gene Name: ribosomal protein L31
  Uniprot ID: P62899
  ENST ID: ENST00000409028
  CDS Start-End: 34-420
cgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaatttctgtgctaaacagtgttacagtcgccaagagcccataaagggagccctcctggaagtggatgaggccttgggtctcggctcttcattgcttcctgagctgcagcagatgcctttacaaccaagctcaccgaggacgtctgtctcccatattaccctggcagagggccaggcctgttctacacggccggggtttcaacaaggtactgatgtcttctgcccttgcctcttcgacaggcaagtaataagacttaagtgaagagaattctttaggcacacaaattcacatttgatgtaatctcattatacttcctgatctgtgattgaaaactttcatttcgtaactagtatgtctgtcccacctttaaaaagtttttcattatgaaagtaagtatttgttagaattaagtctatttaaatgaaaaaaacttagatatgagtctgcatggcctcaggaaaatgatgttttaaaatagagattttaggttgtctgcactctagcttttttgtcgttttcttaaggcttttttaactgcatcaaaaattcagatacgaaacatacactaaaaaataatacatcatatcttaatttccactgaacttgatttaaattcagagttacacagtatgaatatcacaatcagatatgttcaaaaaggtctgaacaattgattttctgaaaccatgaaggactacaaatgcttctaataaatcaatgtaattaaaatgtc

SEQ ID NO: 176546 - DNA, 817 bp, Homo sapiens
  Payload ID: 14652
  Gene Symbol: RPL31
  Gene Name: ribosomal protein L31
  ENST ID: ENST00000409038
  CDS Start-End: 24-416
ctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaagtcttcaaaacgatgatctcttcaaaacagattgtcaccatcagtgagaaaccgaacaagaagaggaaagcaaatggcattttcttctctacttggtgaaaagtcattatagaggattcgaacggttccaatgctcgcaattctacttcaagcatgtgctcattctacatatcaacccctttttcactgacaaatgtaatgttgacaatctaggctaatgggactagattttgaatccaatcaacactttttcatataaagttttcagaataacaaagctttccctcattcatacagatattgctgtactaatctataattatgttttagaattcaaattataacactgactaaacatcactaatgaaacatttgtgacctccttttttccgaagtttaatttttgctttgaattcatattttatcagtatgtgttaatataatgtca

SEQ ID NO: 176547 - DNA, 2328 bp, Homo sapiens
  Payload ID: 14652
  Gene Symbol: RPL31
  Gene Name: ribosomal protein L31
  ENST ID: ENST00000409711
  CDS Start-End: 12-251
cctgcatttagatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggtgctaaagttatctgtattcgaaggtgaacttttgcaatgacaccagcttcacttaaccctgcaagagcccatatcagttcagtaatttggttaatgcatgtggaagtataaaaaaaaaaaatactgtgaccgtgacttagggtgtgtagtatctgcagggaagccccttaatttagtggcttatgaactgagacccaagggaaggagccagcagtgtagggtgggaaagagcattgcagagagaggaagcttggcaggatctgggagcggggtggtgaacgcaggtaaagtggaataaatcactgtgagcccagtggaggagggaggggtgagggtcgctctagacatcatggcaagtccaccaggagagaagtggttcttggcctgcggcagttttacctgtccttcccggggttgtggcgggggtggggggcagtgttttttgtcactactgagggatactgtgggccagggactactaaacatcctacaactcatggggctgctccctcaacaaaaaattgcctagctcagatgttagttctcatgttgggggaccctgctctaaagtggaaccagaaagcaggggaggcttgtgctgtaaaggacgtcatgaggtgccagaacagaagtggagtgaggggcagctagaggaatgatgacagtgtggactagttgattctggaaacgggttgggggaggactgtctgcatctgtgtggtatttaaaccttaggattaagtgagatgaacaagacagggacctgagacctagctcttctgtgggtggacattgaagggtgcagcaggagaggtgtcctccgatgcctgccttgggataagaggaatgggattacaggagccaagagaagtcctgagtttataggaatcggggcctagaacaatacccggcatcgatagaggaaagagaatcagctgtgatgctacggagagggtaagacaggacaaggggattgcatgtggaagatagagaaatagagtatgcgcctgtggcagagtttttaacactgttttttgttcgttttgagatggagttaatgttgcccaggctggagcgcaatggcgtagtctcagctcactgcaacctccacctcctgggttccagctattttcctgcctcagcctcccaagtagctgggattacaggcagccgccaccacgcctggctcttagttttgcatttttagtagagaggggttttaccatgttggccagggtgatctcgaactcctgacctcagatgatgcacccacctcagcctcccaaagtgctggggttacaggggcaagccaccatgccgtttcttcatattttaatgtaacagaaaaatcacgtaacaaagtttctggtgatagacaaaagactaacacatttggaccatttggacccagatatctgcttaggattaaccggttgggtatcaatggtggctaccttaacatgtcttcaaacaagcatccctcctgtggtaacagcatttaatgttcacctgggggttatgtttcattttccagggaactgtaagttctaggttggtcagagtagagcaaaggacagcattagaagcaggcatatgagatatgtgaatacagctagtggctgcttggttgaaaggaggcattgacttcagcaacacaattatgtttttattaggaatgtgccataccgaatccgtgtgcggctgtccagaaaacgtaatgaggatgaagattcaccaaataagctatatactttggttacctatgtacctgttaccactttcaaaagtaagttctccatcccataaagccatttaaattcattagaaaaatgtccttacctcttaaaatgtgaattcatctgttaagctaggggtgacacacgtcattgtaccctttttaaattgttggtgtgggaagatgctaaagaatgcaaaactgatccatatctgggatgtaaaaaggttgtggaaaatagaatgcccagacccgtctacaaaaggtttttagagttgaaatatgaaatgtgatgtgggtatggaaattgactgttacttcctttacagatctacagacagtcaatg

SEQ ID NO: 176548 - DNA, 641 bp, Homo sapiens
  Payload ID: 14652
  Gene Symbol: RPL31
  Gene Name: ribosomal protein L31
  ENST ID: ENST00000409000
  CDS Start-End: 88-327
tggcgacccggaagttgtacttgcaactgcggctttccttctcccacaatccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggtgctaaagttatctgtattcgaaggtgaacttttgcaatgacaccagcttcacttaaccctgcaagagcccatatcagttcagtaatttggttaatgcatgtggaagtataaaaaaaaaaaatactgtgaccgtgacttagggtgtgtagtatctgcagggaagccccttaatttagtggcttatgaactgagacccaagggaaggagccagcagtgtagggtgggaaagagcattgcagagagaggaagcttggcaggatctgggagcggggtggtgaacgcaggtaaagtggaataaatcactgtgagcccagtggag

SEQ ID NO: 176549 - DNA, 716 bp, Homo sapiens
  Payload ID: 14652
  Gene Symbol: RPL31
  Gene Name: ribosomal protein L31
  Uniprot ID: P62899
  ENST ID: ENST00000409320
  CDS Start-End: 24-389
ctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaagtaagttctccatcccataaagccatttaaattcattagaaaaatgtccttacctcttaaaatgtgaattcatctgttaagctaggggtgacacacgtcattgtaccctttttaaattgttggtgtgggaagatgctaaagaatgcaaaactgatccatatctgggatgtaaaaaggttgtggaaaatagaatgcccagacccgtctacaaaaggtttttagagttgaaatatgaaatgtgatgtgggtatggaaattgactgttacttcctttacagatctacagacagtcaatgtggatgagaactaatcgctgatcgtcagatcaaataaagttataaaattgc

SEQ ID NO: 176550 - DNA, 781 bp, Homo sapiens
  Payload ID: 14652
  Gene Symbol: RPL31
  Gene Name: ribosomal protein L31
  ENST ID: ENST00000419276
  CDS Start-End: 6-245
gcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggtgctaaagttatctgtattcgaaggtgaacttttgcaatgacaccagcttcacttaaccctgcaagagcccatatcagaatgtgccataccgaatccgtgtgcggctgtccagaaaacgtaatgaggatgaagattcaccaaataagctatatactttggttacctatgtacctgttaccactttcaaaagtaagttctccatcccataaagccatttaaattcattagaaaaatgtccttacctcttaaaatgtgaattcatctgttaagctaggggtgacacacgtcattgtaccctttttaaattgttggtgtgggaagatgctaaagaatgcaaaactgatccatatctgggatgtaaaaaggttgtggaaaatagaatgcccagacccgtctacaaaaggtttttagagttgaaatatgaaatgtgatgtgggtatggaaattgactgttacttcctttacagatctacagacagtcaatgtggatgagaactaatcgctgatcgtcagatcaaataaagttataaaattgccttca

SEQ ID NO: 176551 - DNA, 717 bp, Homo sapiens
  Payload ID: 14652
  Gene Symbol: RPL31
  Gene Name: ribosomal protein L31
  ENST ID: ENST00000441435
  CDS Start-End: 1-326
gccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaattttttttttaaggtgagttgaagtcttgggaatagactgaaaactaacaaaaccggccccatcgctgaggaccaggtgagcctcttcagaatgcatcatttccacccatactaaatgactacatcatctctttggacatcccaattcacaaaagtctgaagtagttcccagtaactgcagggttcttgaccatttcaatgtcctctgtccacaggatgggacaaaaacaagggcagatgctgtagtctgcaagctcatatcctcaaagagaccaaaatgccatttataattttactgtcatattcactgcagccatgttatttaaatagtcattacagaatcatgaaaataaccacaagaacttttaagtgtgaaataaaggtctcataaatttctgttccttaaaa

SEQ ID NO: 176552 - DNA, 357 bp, Homo sapiens
  Payload ID: 14652
  Gene Symbol: RPL31
  Gene Name: ribosomal protein L31
  ENST ID: ENST00000456292
  CDS Start-End: 12-357
cctgcatttagatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaa

SEQ ID NO: 176553 - DNA, 567 bp, Homo sapiens
  Payload ID: 14653
  Gene Symbol: RPL32
  Gene Name: ribosomal protein L32
  ENST ID: ENST00000273223
  CDS Start-End: 59-520
cccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaaggaagagttcgcactctgcacagacgctaacccacctgtgtattatttccttcagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgcca

SEQ ID NO: 176554 - DNA, 1734 bp, Homo sapiens
  Payload ID: 14653
  Gene Symbol: RPL32
  Gene Name: ribosomal protein L32
  Uniprot ID: P62910
  ENST ID: ENST00000396953
  CDS Start-End: 1293-1700
gcgctgcctacggaggtggcagccatctccttctcggtaagtgttaatccgtggcaatccgcattcctgcgggattcatctggccccgtcgcccagtggtgcggaggcctccccttcagcgcggtagtgtctgtgggtattgttattgtcagcttactggagcgtgtacaggaacagaacgaagccgccgagttgatagggctttgcgtcccagagcctcctgccctccgcctgtattcagagctgcgggctgcttgtttgttccttggcggtggagggtgctagttgaggccagacttcggggtctcctgggggccgtgggacgaccaggggtggcccagcttgacagctttcagctgggatctgtggatcccagcgctcaccaatgtcggcccacgtgtattcgttcatgccatggccggcttcttccgctgcagtctctggcccgagggctgctgctgcgggaccgccaaggaaagacgagctgtaggtcggctggtccagctgcaggcagaaattctggtagtatctctgggaatatgaagatgcaactgcccccaccttgccttcgaggatatcatgggccagaaggcagagtcgttttgaatacgtggttcattgagtacccactctgggccagttgatggctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggtgaggaaaagactcaggttcaagtagatggtcaaggccagtactaccggaaggaccatctgggggttcggacactggtggggtgggatttgctgccccttgcaaattgagagtgtcttggggtcagttttgatttgctcagctgttggcattctttgggctctgagtgggtgaggtgacccttgacctcctgggatcgcatctggagagtgcctagtattctgccagcttcggaaagggagggaaagcaagcctggcagaggcacccattccattcccagcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaat

SEQ ID NO: 176555 - DNA, 1749 bp, Homo sapiens
  Payload ID: 14653
  Gene Symbol: RPL32
  Gene Name: ribosomal protein L32
  Uniprot ID: P62910
  ENST ID: ENST00000396957
  CDS Start-End: 194-601
aggggttacgacccatcagcccttgcgcgccaccgtcccttctctcttcctcggcgctgcctacggaggtggcagccatctccttctcgctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtc

SEQ ID NO: 176556 - DNA, 620 bp, Homo sapiens
  Payload ID: 14653
  Gene Symbol: RPL32
  Gene Name: ribosomal protein L32
  Uniprot ID: P62910
  ENST ID: ENST00000435983
  CDS Start-End: 169-576
ccttctctcttcctcggcgctgcctacggaggtggcagccatctccttctcgcttgctccgtagctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactg

SEQ ID NO: 176557 - DNA, 555 bp, Homo sapiens
  Payload ID: 14653
  Gene Symbol: RPL32
  Gene Name: ribosomal protein L32
  ENST ID: ENST00000457131
  CDS Start-End: 156-555
cttctctcttcctcggcgctgcctacggaggtggcagccatctccttctcgctggcgattggaagacactctgcgacagtgttcagtccctgggcaggaaagcctccttccaggattcttcctcacctggggccgcttcttccccaaaaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaa

SEQ ID NO: 176558 - DNA, 439 bp, Homo sapiens
  Payload ID: 14653
  Gene Symbol: RPL32
  Gene Name: ribosomal protein L32
  ENST ID: ENST00000434963
  CDS Start-End: 254-439
ctgcgaagagagcagaaggggtgctgctgtaggaaatcaatggctcggaagaccacactgaggaaggtgtgagttgatactggaagatctccaggtttgaggcatcttcagaggtatatggtggttttgtgtgtgttgagggtgtggtagcgcagcagctccctagggaattagaaggttttattgaacatttaccctgtgacaggcactgcaggcattcagcgcgcagtgtcatcttcattttacaggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagc

SEQ ID NO: 176559 - DNA, 2117 bp, Homo sapiens
  Payload ID: 14653
  Gene Symbol: RPL32
  Gene Name: ribosomal protein L32
  Uniprot ID: P62910
  ENST ID: ENST00000429711
  CDS Start-End: 101-508
ggacccaggggttacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtcatttttgggattttgtttttgagactcattctgtcaccccggctggagtgcagtggcttgatcttggctccctgcaacttctgcctcctgggttcaggcgattcgattaacaattggagacgagtcgtgcagaggaaagaagtaacttagaatctaatctttattaacctgggatatcacagaaaatacttgggcctgccacttgtatttctttgtcctcaatactgaacactagacacatttgaaaccttcctcagaaggaaacaaaccaactggttatgcctgggtggtggcatggaagatgcccattgttgcccaatttgctaataagtattttgaaattagaaatgaaacatgaggtccaagcctgtccagttccctacccaacccattcctcctccctggaaaaaagaaacccgtatcatcttccaaatttctgattcatcactgccacttaaaaa

SEQ ID NO: 176560 - DNA, 529 bp, Homo sapiens
  Payload ID: 14654
  Gene Symbol: RPL34
  Gene Name: ribosomal protein L34
  Uniprot ID: P49207
  ENST ID: ENST00000394665
  CDS Start-End: 133-486
gttgtctgcaggtatggatgttgttctcttttccctgtctttatttccttaccaatcggctgccatccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgt

SEQ ID NO: 176561 - DNA, 441 bp, Homo sapiens
  Payload ID: 14654
  Gene Symbol: RPL34
  Gene Name: ribosomal protein L34
  Uniprot ID: P49207
  ENST ID: ENST00000394667
  CDS Start-End: 45-398
cttttttcttcctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgt

SEQ ID NO: 176562 - DNA, 853 bp, Homo sapiens
  Payload ID: 14654
  Gene Symbol: RPL34
  Gene Name: ribosomal protein L34
  Uniprot ID: P49207
  ENST ID: ENST00000394668
  CDS Start-End: 67-420
ccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtccaatagaaaaagttggtgtgctggagctacctcacctcagcttgagagagccagttgtgtgcatctctttccagttttgcatccagtgacgtctgcttggcatcttgagattgttatggtgagagtatttacacctcagcaaatgctgcaaaatcctgttttcccccagagagctggaggttaaatactaccagcacatccctagatactactcaagttacagtatatgatcactaatatagtatgctcttggtaccaggagctctgatatatatctggtacatgtttgataatgacttgattgttattataagtacttattaatacttcgattctgtaaagagtttagggtttgattttataaaatccaaaatgagccttttattgaa

SEQ ID NO: 176563 - DNA, 549 bp, Homo sapiens
  Payload ID: 14654
  Gene Symbol: RPL34
  Gene Name: ribosomal protein L34
  Uniprot ID: P49207
  ENST ID: ENST00000506397
  CDS Start-End: 156-509
tttccttaccaatcggctgccatccgaggagctgaggaagcctagagctctcagaagcagtcctttgagctggtgtagggcggtgtttctccaactgggctcgtggcacttttctggacaccactccaaacaaaattagactctgagcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgc

SEQ ID NO: 176564 - DNA, 560 bp, Homo sapiens
  Payload ID: 14654
  Gene Symbol: RPL34
  Gene Name: ribosomal protein L34
  Uniprot ID: P49207
  ENST ID: ENST00000502534
  CDS Start-End: 42-395
ttttcttcctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgctggagtacaatggcaggatctcggctcaccgcaccctctgccttccaggttcaagtgattctcctgcctcagcctcccaagtagctgggattataggcatgtgccaccatgcctggctaatt

SEQ ID NO: 176565 - DNA, 455 bp, Homo sapiens
  Payload ID: 14655
  Gene Symbol: RPL35
  Gene Name: ribosomal protein L35
  Uniprot ID: P42766
  ENST ID: ENST00000348462
  CDS Start-End: 50-421
cttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgag

SEQ ID NO: 176566 - DNA, 493 bp, Homo sapiens
  Payload ID: 14655
  Gene Symbol: RPL35
  Gene Name: ribosomal protein L35
  ENST ID: ENST00000373570
  CDS Start-End: 4-294
gcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaaggcagcagctggtgggccctgcatacagatggacagagtactgcctcagcccccagcatgctcttgctaaccagagccgagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgagactg

SEQ ID NO: 176567 - DNA, 692 bp, Homo sapiens
  Payload ID: 14655
  Gene Symbol: RPL35
  Gene Name: ribosomal protein L35
  ENST ID: ENST00000493018
  CDS Start-End: 24-314
cggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaaggcagcagctggtgggccctgcatacagatggacagagtactgcctcagcccccagcatgctcttgctaaccagagccgaggtaatggtaactacccccggggcttggtgggtgctgcgtgccctgtactaggttgtcatgtgactgtcctcgtgactgggaatcgggcagtggaaggagcactgagttgggagtcacttgactgagatgcaagccccggctcttccacagctttgccaagacttggacactcagcccagtagggcaagaagtacaagcccctggacctgcggcctaagaagacacgtgccatgcgccgccggctcaacaagcacgaggagaacctgaagaccaagaagcagcagcggaaggagcggctgtacccgctgcggaagtacgcggtcaaggcctgaggggcgcattgtcaataaagcacagctggctgaga

SEQ ID NO: 176568 - DNA, 340 bp, Homo sapiens
  Payload ID: 14655
  Gene Symbol: RPL35
  Gene Name: ribosomal protein L35
  ENST ID: ENST00000629845
  CDS Start-End: 50-340
cttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaaggcagcagctggtgggccctgcatacagatggacagagtactgcctcagcccccagcatgctcttgctaa

SEQ ID NO: 176569 - DNA, 517 bp, Homo sapiens
  Payload ID: 14656
  Gene Symbol: RPL35A
  Gene Name: ribosomal protein L35a
  ENST ID: ENST00000442341
  CDS Start-End: 236-517
ctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgct

SEQ ID NO: 176570 - DNA, 549 bp, Homo sapiens
  Payload ID: 14656
  Gene Symbol: RPL35A
  Gene Name: ribosomal protein L35a
  Uniprot ID: P18077
  ENST ID: ENST00000448864
  CDS Start-End: 139-471
tcttaccgccatcttggctcctgtggaggtgagtgaagggtctgctgctgaaatttgggggcaaataaccggagtaggtttgttcctgtgccttggcgagtcgccggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 176571 - DNA, 442 bp, Homo sapiens
  Payload ID: 14656
  Gene Symbol: RPL35A
  Gene Name: ribosomal protein L35a
  ENST ID: ENST00000429437
  CDS Start-End: 49-216
cttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactgcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 176572 - DNA, 564 bp, Homo sapiens
  Payload ID: 14656
  Gene Symbol: RPL35A
  Gene Name: ribosomal protein L35a
  ENST ID: ENST00000439255
  CDS Start-End: 15-188
ttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaactgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgta

SEQ ID NO: 176573 - DNA, 1437 bp, Homo sapiens
  Payload ID: 14656
  Gene Symbol: RPL35A
  Gene Name: ribosomal protein L35a
  Uniprot ID: P18077
  ENST ID: ENST00000464167
  CDS Start-End: 268-600
cttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatca

SEQ ID NO: 176574 - DNA, 707 bp, Homo sapiens
  Payload ID: 14657
  Gene Symbol: RPL36
  Gene Name: ribosomal protein L36
  Uniprot ID: Q9Y3U8
  ENST ID: ENST00000347512
  CDS Start-End: 135-452
gaagactccagccgccagggggagcgcgtgccgttcttgcctctctggcctgcgcctcctgagccgagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaagccctggctctcctgctgtccgtgggtgggtgtgggtgtgtcgggggcccgcagtcccctgtctggtgcccgctctgagccacaccctctccgggtgctgcctggtcgtgaatcaaaagccgtggcccgcccacccttcccggggcagcaggtgaggaagccgccgtactgcaaatgactttaatcattaaatagcttctatgccacac

SEQ ID NO: 176575 - DNA, 556 bp, Homo sapiens
  Payload ID: 14657
  Gene Symbol: RPL36
  Gene Name: ribosomal protein L36
  Uniprot ID: Q9Y3U8
  ENST ID: ENST00000394580
  CDS Start-End: 193-510
ggagagcagcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 176576 - DNA, 449 bp, Homo sapiens
  Payload ID: 14657
  Gene Symbol: RPL36
  Gene Name: ribosomal protein L36
  Uniprot ID: Q9Y3U8
  ENST ID: ENST00000579649
  CDS Start-End: 86-403
actgtggtgcccaaggagaagaaaagtggtttcccgcactgccggtatccgccgccatccggactcccgggtcctctgtgcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacagaa

SEQ ID NO: 176577 - DNA, 239 bp, Homo sapiens
  Payload ID: 14657
  Gene Symbol: RPL36
  Gene Name: ribosomal protein L36
  ENST ID: ENST00000582463
  CDS Start-End: 36-239
ccttccgccacggccgtctctggagagcagcagccatggccctacgctaccctatggccgtgggcctcaacaagggccacaaagtgaccaagaacgtgagcaagcccaggcacagccgacgccgcgggagggagcaccttgagagcggcgcggggcagcgggtttggggttctgacgcaggagtaggagttcgctcatggagctggcccgaggttgcggtgtgtgaggttgagggattt

SEQ ID NO: 176578 - DNA, 874 bp, Homo sapiens
  Payload ID: 14657
  Gene Symbol: RPL36
  Gene Name: ribosomal protein L36
  Uniprot ID: Q9Y3U8
  ENST ID: ENST00000577222
  CDS Start-End: 545-862
cgagaagagaggaccgtgggggcgttcgcgtggctcccagcccgggaccccacccccgctggacagtgggggaaactgaggcctgagcggagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaagggtcggcccgaaataggcggagttgggattcgaactcatttcacaggcagagggaggagagcagccatagccacctccactggttccgactccagctcccgggctcgcaggagtaaacgcgcatgctcagggagctcggtcgcgcatgctcagcgcaacggcggggaagactccagccgccagggggagcgcgtgccgttcttgcctctctggcctgcgcctcctgagccgagtagatatcccggagttccgcgcggcgccagcccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctg

SEQ ID NO: 176579 - DNA, 452 bp, Homo sapiens
  Payload ID: 14657
  Gene Symbol: RPL36
  Gene Name: ribosomal protein L36
  ENST ID: ENST00000579446
  CDS Start-End: 25-309
ggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtaggtgggcgctgccggccgaggggcggggtgggatgggagtcagggccgggctgacggcggcctcgtccctggcaggtggggacgcacatccgcgccaagaggaagcgggaggagctgagcaacgtactggccgccatgaggaaagctgctgccaagaaagactgagcccctcccctgccctctccctgaaataaaga

SEQ ID NO: 176580 - DNA, 433 bp, Homo sapiens
  Payload ID: 14658
  Gene Symbol: RPL36A
  Gene Name: ribosomal protein L36a
  ENST ID: ENST00000372849
  CDS Start-End: 29-241
tttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaagaggcaaaaaattgaggaatgtgccctgctttcctaagaactgaagtgctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagt

SEQ ID NO: 176581 - DNA, 691 bp, Homo sapiens
  Payload ID: 14658
  Gene Symbol: RPL36A
  Gene Name: ribosomal protein L36a
  ENST ID: ENST00000392994
  CDS Start-End: 56-394
acttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaaggtatataattatgggtggaaggtgcaatctttttcatagctttattatttgaaaaggtgaacatctattcattgtggcatagagctcaggggtaatcctctaaaaatattagatctatagctaaagatatgtgaggtcttttgctacaaggaggaaaggaagaatgaggcagcttaacagcatggtgagtattttaggaacagataatgttcttaatggggcagtagttcatggcaaaatacaaaacaacttttttctgttctgttacagggccaagtgatccagttctaagtgtcatcttttattatgaagacaataaaatcttgagtttatgtt

SEQ ID NO: 176582 - DNA, 910 bp, Homo sapiens
  Payload ID: 14658
  Gene Symbol: RPL36A
  Gene Name: ribosomal protein L36a
  ENST ID: ENST00000427805
  CDS Start-End: 113-541
gtcggggtgagtggaccaccctttaggcggagtccttccttaagctcccgcccgcggctccgaactgagtcctctcagccgcccgagggcgctgcgctgagccttacactctatgattgctcctaccgactcccatgaggaagtgcgatcgggaacctcctatatacttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcacttcatttgtttgctgttcatcttttgggagggaataagctagagccatcaatacaattccgcttgtggggaaatttatgcctcttactggtactacttgttttgcattgaagctgactggttgagttcacatcatatgttgcaattttctaatttggcacttcaatcactaggggccttatgaggcagtttgtcattatgcaatggttattggttatcatgtgagtagacacatttcaggctaatagggagaagtcagtaacacattcatagtgaatatgagatgtctttgctaagagttaagtgtcagatctttgttata

SEQ ID NO: 176583 - DNA, 429 bp, Homo sapiens
  Payload ID: 14658
  Gene Symbol: RPL36A
  Gene Name: ribosomal protein L36a
  Uniprot ID: P83881
  ENST ID: ENST00000553110
  CDS Start-End: 62-382
ctatatacttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttca

SEQ ID NO: 176584 - DNA, 399 bp, Homo sapiens
  Payload ID: 14658
  Gene Symbol: RPL36A
  Gene Name: ribosomal protein L36a
  ENST ID: ENST00000471855
  CDS Start-End: 275-352
cggggccaggaattgaagtgatgggttcaaagaggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttca

SEQ ID NO: 176585 - DNA, 881 bp, Homo sapiens
  Payload ID: 14658
  Gene Symbol: RPL36A
  Gene Name: ribosomal protein L36a
  ENST ID: ENST00000614077
  CDS Start-End: 47-475
gagtcctctcagccgcccgagggcgctgcgctgagccttacactctatgattgctcctaccgactcccatgaggaagtgcgatcgggaacctcctatatacttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcacttcatttgtttgctgttcatcttttgggagggaataagctagagccatcaatacaattccgcttgtggggaaatttatgcctcttactggtactacttgttttgcattgaagctgactggttgagttcacatcatatgttgcaattttctaatttggcacttcaatcactaggggccttatgaggcagtttgtcattatgcaatggttattggttatcatgtgagtagacacatttcaggctaatagggagaagtcagtaacacattcatagtgaatatgagatgtctttgctaagagttaagtgtcagatctttgttataacagttaatttaataaagaattttggcattgttcttc

SEQ ID NO: 176586 - DNA, 746 bp, Homo sapiens
  Payload ID: 14659
  Gene Symbol: RPL36AL
  Gene Name: ribosomal protein L36a-like
  Uniprot ID: Q969Q0
  ENST ID: ENST00000298289
  CDS Start-End: 161-481
attggtttgcagtactgtcgctcaggtgcagttcccacttccgcctgtttcttccctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaactttttgtggtttttacttataaatagaattccatgtttagtgtagtcccacctcaaactttactaacaagtttatatatgtatgaagggaaaatactactttactactttttgttttctggtcaatttcaaatgttgaatgaattcataaacattgagcagcttagaa

SEQ ID NO: 176587 - DNA, 7686 bp, Homo sapiens
  Payload ID: 14660
  Gene Symbol: RPL37
  Gene Name: ribosomal protein L37
  Uniprot ID: P61927
  ENST ID: ENST00000274242
  CDS Start-End: 151-444
ctcttgaccccacctacactacgacgacggacgctcgagaacgctgcaccgcgccccgcaggaagtgcttccctgggcggaagcttctgagcgtgatatagcggaagtgccttctcttccggtctttctggtctcggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaatacatatctggttttggtaaggtatttttaatcaattaggcttgtagtatcagtgaaatactgtaggtttagggactgggctagcttcatatcagatttacttgttaagtgactgttttggaatgtttacttttggactgggtttgtaacacggttaaaggcaatgagaaacaagcagaattccaggagtccttgaagcagagggcactggaagacaatatagcagattaaaatagcacagctcatgtggcataggtgggtattttagatgtttgagtaaatttgaaagagtatgatgtttaaattacctttagcaacatgttcatctgctatgctgtcatgactagggggatgattattagtcacatagagcttgggagtaccactggaaacgtatgggtaggagtttaggtggcttctgtttttcaaaagatgatcttatcctagtatctgtaatgctcacttggcacacctgacttgtgggctgtgtgtaaggtggctagctaagtgaaaaaagcctgctaggtgtgagtcaacttaagaatatgtaaataggtttgagaaaaagtagggcttgggtgcaagtaaagattgagcaggaaataaaggaaaatcaagtataatccctgagatttgtagactaaaggcaatgatgtgggactacttggtcgaatttttttagccctcaacttggtaattgggtgtttctgtgttaaagcactgaaacttgctgtcgtgccttcctagttttcgtggtttattgacagggttgggggttttttttgtttttttaaaatgaagggacaaagtcaactggactgctgagtgagagggcaggggcagttgaagggaacatgaattgctggaacagctacataaaatagtgatgtagccaagtcatgctatttaaattataattctccactgtgtttagaataacatctgaggttcttaacctggccttggaagggtatcacttttacttgtaacctggaatggctttataatgtgctagctaattgctactctcatcttgtattttaactcctaatttacccttcaggtctcagcttcagaacattcacttataaagaaaccctgctgattaaatctctcttgggcttcctcccgaaatgtgagactatactttaaagatgtatggttagagtccaattgccattgcctttcttgtttacagatagtgcaatggcgcaatcctggctcactgcagcctctaattcctgggctcaagtcaagtggttctcctgcctcagccttctgagtagctgggactacagatgcacaccaccacacctggctaatttttgtgttttttgtagagatggagattcactcgactaattctttttgtattcttagtagagactgggtttcaacatgttgaccaggctggtctcgaactcgacctcgtgatccgccgcctcggcctcccaaagtgctaggattacaggcgtgagccaccactcccggctgtcatcatcaaattttcaagtgaagatagtctgttgaagattgaacaatgaccttgaaagacagctgagttgctgtgggtataatgtaaagctggtgaagtttggccagtttgggcttcagaagtctaagtctagtgaaggtaccctgacccccatataaacaacccttgaggccggtgtggtggctcacggctgtaatcctggcactttgggaggccgaggtgggcggatcacaaggtcaagagatcgagatcaccctggcccacatggtgagaccccaactctactaaaaatacaaaaattagctgggtgtggtggcatgtgcctgtagtcttagctacttgagaggctgaggcaggagaatcgcttgaacctgggaggcagaggttgcagtgagctgagatcatgccactgtgctccagcctggtggcacagtgagactccacctcaaaaaaaaaaaaaaatccttgaactaatgactcaaattttcaaatgaaacaaaataagcagtggatcttgcattggagatggagttaaactatgttgcccaggctggtcttggactcctggtttcaagtgatcctctcatcttggcctcccaaagtgctgggattacagggacgagccaccacaccccacctattgtctatatttctatctttaacagcacttcagtcctgccttaagttatagttatgtatagatacccattatactttaaatttttcagcagaaattatgcttttatcttctctgcagtgttatatgttggtgtgcaaaaatgttaaatttatttttcctaagtaccccatctgcttttcaactctgtcctctgcctgaaaagcctccctccagcccctacttccctcccatcttagttcacaaagtcaggttgatttgcccccagctgtcaaagcagactacctgtttccacatgtaactggttatgttctgtaaagttacaaaaatagaaaggttgaatctgtggcggccgggtacggtagctcacgtcctatagtcgcagcactttgggaggccaaggtgggcagttcacgtgaggtggggagttcgagaccagcctgaccaacatggagaaaccccgtctctactaaaaatacaaaaatattagccgggcgtggtggtgcatgcctgtaatcccagctactagggaggctgaggcaggagaattgcttgaacctgggagacggaggttgcggtgagctgcagaggcctcacctctaattgagacacaattatatattgttgatatatatatatatatatatacacacacacacacacactatgatggataaatgcatgagtttctgtgagagcattggaaaggagtttgtcactcaataggtgaagccaggctaagatttaagctgagccagggaggacttgaaggaatcatgatgagagagaaggtaagtggctttgccagcaatgaaacagctgacataatggtaaccagtcagaggagggcataactatgaaactggacaccttggttgtcaggttagaaggatggggtgtagggttggtaagaaaagaattcagggaagagcagcgatcagattatgaagaatttgtcttgagaaattacagaggatttaaaccagaatgttaggaatagttattctagcaagatgaatgtggaaagtgttagtgtgcatgtgatgagtcttgaagctggaaactaggtaacaggttcttaaatagttcatgtgaaaatcatgacagactaaggcagtggctgtggggctgtccgggagttctctacagaaaacatctaaaacttgaatgtgcaagtgagtagctaacttccaagcttcccatttctgtataatttaagcatgaaaatgagaacactgagatttgataggcatgtagaagtcagagtaagcaagagggcttgagttcatcgatgaacttcagtaactatccttgacttagtattggtggaaaccatttgtgaatttacagactccaaaaacaaaaagataatttagagtctcaaagtaagatttggggagatgtccattggagacagaagtggagagagggagaagttcatttgttgacatatttatgtatggtgcacctactgtgtgccaagccatgttagagatacagtgggagcaaaaccagatgtgttttctgccctctgactccagtggttgcagaattagcccaggaactagaattggatggagtcacacaaaccaaggaaggggattgtttgaggggggcactcagtcacatgtggctgaggccaaagagaatgaagatatattttaaaattctggatttggcaaaatttaggctagtctttacttttcataaacctctctcatgttagagcagcaaagaaaaaccagtttgccaagaggtcacgagattgggcagtgaggaatggggagtttagtttaaaagacaacactagatacttttggaagtttacctattctgtggttcccttttattgactaaatggtgcccttcattcatgaagcaagtatctatttagtgactactatgtgtcaaaagctatctaggcccagaaacttttaagtggaaaacaaaacaaagaccctgccctgacagatttcaatcatgtatatactgtatgtatgtttgtggaaggtgacataatagacaattgcagatagtgataagtgtgtaagacaaggataccacgagcgtaatagacagtggggatggaggaacctttagaaggttggttaagttgaatgataaggagccattcttttgtctttacctgaatgacttatcattcagccctttttgagttttgggttgcttgcagagtttaaccttgcctgtaattgaaacttaattttgtaatagcataacttcatgtaagaaaagcaaagcaatacattacagaattattttactgaagaacttgtttcagagaaagaggctgtttcacatttattagcacatttggattatatttaggtgttttatttttttttaaacaaaggagtttggatcataatacaagagaagcacagggcaaagacactgcataacctcaagaactaagaatggaaggactggccaggcctggtggtgcacacctgtaatcccagctactcaggaggctgaggcgagagaatcgcttgagcctggggggcagaggttgcagtgagctgagagaacggcgggcggcagagcgagactccatctcaaaaaaaaaaaaggataaaggaaggacttaagcaaaatcttccttgtaagtagaaggatgttttgacaagaaaagttgcaatggaaaaatggttctcatgtacacgagtatgtagaataagcatcgtgtgtggattggattcagatcaaaacattgcttttatgtttgtgtctttatacggtgggagtataccctggtgccccaggatgaagacttgacctgacccatgtatttttagattactcacagataacaaaaagtattttcatcatgattagttgcgaaaacagttttatttcaataggtaaaacgtgcagtcctatgtaatcgtcagaaggtaatcttaattatagcttgggtgtgctttaaactgcaagctggcagtggagggcacgattcctctgatttcagctttctccttatacttttctggagctgtgagctgcaagttaactcagtgggattaaagtgtagactggaggtacaaaaggtgaggagtgaggagatagggtagttcttccttggctggctggcttcataatccctgggccccgcagataattaaatcgactttttctgtctcaggcatttgtatgacctctttggaggttccctgctgggtagttatccttgtatctgatggacccatctcaatttaaaatactctgccaggttcggaggttcatgcttgtcatcccagcactttgggaggctcagaggtgccattggcttgagcccaagagtttgagaccagcctgggcaacctggtgaaacctcttctccattaaaaatacaaaaaattagccaggcatggtggtatgtgcctgtagtcccagctactcagggagctgaggtggaaggattgcttgagcctgggaggtcaaggctgcagtgaaccttgattgtgccactgcactccagcctggatgacaaagaccctgtctcaagaaaagtctgtaattctttcctaacccttagtatccagcctcagtcctgaggttttctttacctctgggggctattttatgccggctctctcctgagtgtcacacatctggtcctcaggaaacattctcacatccctggcctgaaaaaaacaatttcagggagatcgcatggcagcagccctctctgggctccccagctaaatggttgtacgaaacacatttcaaagctctctgaagggcttccttgaagttcctttcactgggtttcaaagtagaaggtagtaactcctttgtccaagaaggctgaattgagcacttaacaattctccaaagaaatttcttcattggtctctatcctagaccccttctgtatccttgatatggctgaggattctaaaaaatgaccagtcttacatgggagggctgggatataaaaaataaaataataaataatgataaaaactgaaaactgaccacgttcttggatatgttttctttgggttgtgtgtgtgtgtgagacttttgatagttacccaaagtaggaaaaatcccattctaataaggttatatttatgtagctctgcaaataaacatctagcaaatgtaaaaagtattttctttgccttaaaaatgattaaaattatttgaactcctgaggagtgttatatgaataaaattagtaagttatttggaggaaagttattttttaaaaagacaactggtaaaacagtacaggagaaaggccagcttcctcaagtgaggacagttgtttagaattgactgaggagcggccgggtgcggaggctcacatctgtaatcccacacgccttgggaggctctgaggcgggtagatcacctgaggtcaggagtttgagaccagcctggccaacatggcgaaaccccgtctccactaaaaatacaaaaattagccaggtgcagtggcacacacctgtaatcccagctactccgaaggctgaggcaggaggatcacctgagcccaggaagttgagactgcagtgagctgagattgcaccactgcactccagcctcagtgacagcgagactgtctcaaaaaaagaaaaaagtgactgaggaggaagaggccaggtggcaaatggaacagaatcaccaaagggtgaacaggactaaggcaatgtagtgtatggctcagctacgtcagagtggaaaaggtgttattagagcagaaactatggtccctgcgtcacagggaagcaacctacagagaagcagcagctccccaagagaggagagataagaagccagaagcctcagagtgaacaattgtcctattagggattgctctagagagagaaacctctgggaacgtacccctgtgaggcagcacagcacaatgcttttagaattgtatgagagttgatatatctccatttgttttgcaaaggcaaaaactaagatacagagattatctgttaaagttatgtatttctttggtaataaagatgctgacagtgttgctggaatgcatttctttaataaagatattgtacaatgaaa

SEQ ID NO: 176588 - DNA, 637 bp, Homo sapiens
  Payload ID: 14660
  Gene Symbol: RPL37
  Gene Name: ribosomal protein L37
  ENST ID: ENST00000509877
  CDS Start-End: 28-252
ctttctggtctcggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtgcatggattccgtgaaggaacaacacctaaacccaagagggcagctgttgcagcatccagttcatcttaagaatgtcaacgattagtcatgcaataaatgttctggttttaaaaaatacatatctggttttggtaaggtatttttaatcaattaggcttgtagtatcagtgaaatactgtaggtttagggactgggctagcttcatatcagatttacttgttaagtgactgttttggaatgtttacttttggactgggtttgtaacacggttaaaggcaatgagaaacaagcagaattccaggagtccttgaagcagagggcactggaagacaatatagcagattaaaatagcacagctcatgtggcataggtgggtattttagatgtttgagtaaatttgaaagagtatgatgtttaaattacctttagcaacatgttcatctgctatgctgtcatgactagggggatga

SEQ ID NO: 176589 - DNA, 553 bp, Homo sapiens
  Payload ID: 14660
  Gene Symbol: RPL37
  Gene Name: ribosomal protein L37
  ENST ID: ENST00000508493
  CDS Start-End: 28-276
ctttctggtctcggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggtacagtttgtatgttcgatcataattggtccagtgggcttgaatgaaaccctcgtgtttacttgtaaaaagataacagtaccctgatggttactggggatgagatgttggaagctttttatttattgttgtttttgaggcagggtttcactatgttgcccaggcttgagtgtagtggcacgatcacggctcagtgcagcctcagtctccccagcctcaggtaatctcatctcagccgcccgagtacccgggactacaggtgtgcgctgccacatgcccagctaatttttgtatttattgta

SEQ ID NO: 176590 - DNA, 495 bp, Homo sapiens
  Payload ID: 14661
  Gene Symbol: RPL37A
  Gene Name: ribosomal protein L37a
  ENST ID: ENST00000446558
  CDS Start-End: 21-248
cggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaacagaatggaataacagcaaacaacattggaggaggacttgtctgggagagcagccattttaaagaagagcacattaagtcacaaacagtcgcagctgatctactttgcagcatcgccatacatgcctaactaaatattgaaatcccgggaaaaactcactgtgcatcatgttccagaaactagctttgcaaacagtcttttcagatgtgtacattttgtgtatttgaggcatataatatatatattttcctccatgttca

SEQ ID NO: 176591 - DNA, 385 bp, Homo sapiens
  Payload ID: 14661
  Gene Symbol: RPL37A
  Gene Name: ribosomal protein L37a
  ENST ID: ENST00000420712
  CDS Start-End: 14-190
aggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaggagaaagggaggctttcacatccctgacaataagaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaa

SEQ ID NO: 176592 - DNA, 401 bp, Homo sapiens
  Payload ID: 14661
  Gene Symbol: RPL37A
  Gene Name: ribosomal protein L37a
  ENST ID: ENST00000456586
  CDS Start-End: 136-342
gggccttcggagcgcgcggccagccctgggcactggtttcgttgggttgaatttagggaaaactaggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 176593 - DNA, 3647 bp, Homo sapiens
  Payload ID: 14661
  Gene Symbol: RPL37A
  Gene Name: ribosomal protein L37a
  Uniprot ID: P61513
  ENST ID: ENST00000491306
  CDS Start-End: 687-965
gactttcctcaggaaacaccaggctcttctgaattagtcgcgagcagaaccatcgtcctttccttcagaactctgaccagtttgaaactgtctaacttcttaatgtggctatatgatcgtttgcagctggcctgcaacttgttctgggaatggaaccttggattttagtcaccactgtcgctagcatcctgcacagtcagccacttttagagagcataatgcagagggggaaataaatgagatttggaatagagacggggtttcaccctgctggccaggctggtctcgaactcctgacccaccccgcctcccaaagtgttagaatcacaagcgtgagccaccgcgcccggccccacaaatgtaagatttatgcacttctccaagccaagtgctgtgcatcgaatggaggaactcgtacctttgcaggattttgtgatatatgtgaaataatccggacatgcttctgctatggttgtttgtcgccatagtttgcgaatctgggtaaacctggatgagagagacgccttacaattgcaaacatttctcaggaggccgcctgaaaacgcccaaaccatagagctcagttcctagctaggcctctaccagccacttccgctcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagcctcctgagtagctgggattacaggcacgcaccaccatacctggctaatttttgtattttgagtagagatggagttttcaccacattggccaggctgttcttgaactgacctcaagcgatccacctgccttggccttccagagtgctgggattacaggtgtgagccaccacgcccagccttgcatttaatatttttataatgtgtctaggctgggtgcggtgactcacgcctgaaatcccagcactttgggtggctgaggcaggtggattacttgaggccaggagattgagaccagtgtggccaacatagcaaaaacccgtctcgacgaaaaatacaaaaaatagcttggtatggtggcacatgcctgtaatcccagctactttggaggctcaggcacaagaatcacttgaacctacgaggcggaggttgcagtgggccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttcacttggtctgacccctatcttctataacttgtttttttgctcattactggcctttgcacggatgtctcccttcacctgtacctcctgcattgcctctggcagaaacatcgctaccccaggagaatacttcactgggtcaggcatttgctagatccatagcagtaactcatctgtggatctcatttgtgtcacaaaatggtactcctactgattttgtaatgtgaagcaagtactgtgggtcagtaggggtaggaccaggagtgacaagtcaggattttcaggcttcataggaatgacacagctctccaggtgaatctcctggagaattctccataggatctccaggtgagtgaccaggatttcatgtaagcatagggaattgaatgagcattagatggtctaatgctgcggttaagaacaccaacttagccaaactgcctagatagttgggtgacttgggttaagtgacttaacctctctgcttcagtttcctgtataattcttggtagtagaatggagtatatgctgggtgtttggattattaatttggagtcttacaaagctgctatgttacatgattaggcatggaaaacttcggtttttataatcagtgaagtactgctttttgtttgttttctgagagagtgtctgtcacccaggctgaagtgcagtggcatgatctcagttcactgcagcctctacctcccgggttcaagcagttctcgtgcctcagcctccgaagtagctgggattacaggcttatgccacaaagctcagctagtttttgtattttttatttttagtagagatgggctttcgccatgttgaccaggctggtctcaaactcccaggctcaactgataacgtctgccttggcctcccaaagtgctgggattctgtaagccacctcacccagccatgtattgcttttttatgacagttaaaagaggaaagggcgggggacagtttacagaccagtgaaagtgctgagataaatatttttatacctaaggaaatagtgattttcccaagatgatagggaggcaggtgatgtagatagggctgaagattagatttctggctcctatctgtgattttctgctgtaccagtctgccttctattttatgggctcagtattccttacctgcctcttcccatgctaaagatggcccaccttcgttttgttatttaagcaacttcatcccctggcttgttttcacagtggttttctgagcctttgactctaagtcatctaattgaacattgtgttgtgatataaaaagtaagttaggcttgtgtttttca

SEQ ID NO: 176594 - DNA, 775 bp, Homo sapiens
  Payload ID: 14661
  Gene Symbol: RPL37A
  Gene Name: ribosomal protein L37a
  ENST ID: ENST00000598925
  CDS Start-End: 254-436
gggccttcggagcgcgcggccagccctgggcactggtttcgttgggttgaatttagggaaaactaggtcatatgtaattcacatgtcggtcacacgtcagtgaggtggaggaacggtgtgtggaggctccagggcctgcctgggttccaggtctatcactggtttctcccttcactctaaacaggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaaagatgccaaaatggaaccaaatctccatgaactctgctaatggaagacgaggaaaaggcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaaccca

SEQ ID NO: 176595 - DNA, 425 bp, Homo sapiens
  Payload ID: 14661
  Gene Symbol: RPL37A
  Gene Name: ribosomal protein L37a
  ENST ID: ENST00000600880
  CDS Start-End: 26-244
gggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaagtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaa

SEQ ID NO: 176596 - DNA, 529 bp, Homo sapiens
  Payload ID: 14661
  Gene Symbol: RPL37A
  Gene Name: ribosomal protein L37a
  ENST ID: ENST00000441179
  CDS Start-End: 111-293
agggaaaactaggtcatatgtaattcacatgtcggtcacacgccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaaagatgccaaaatggaaccaaatctccatgaactctgctaatggaagacgaggaaaaggcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgc

SEQ ID NO: 176597 - DNA, 698 bp, Homo sapiens
  Payload ID: 14661
  Gene Symbol: RPL37A
  Gene Name: ribosomal protein L37a
  ENST ID: ENST00000427280
  CDS Start-End: 254-520
gggccttcggagcgcgcggccagccctgggcactggtttcgttgggttgaatttagggaaaactaggtcatatgtaattcacatgtcggtcacacgtcagtgaggtggaggaacggtgtgtggaggctccagggcctgcctgggttccaggtctatcactggtttctcccttcactctaaacaggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaagaaaatgagtgcagagaatggacagcagagggagcccttgatgagttttgaccatcaagagatgccaaaatggaaccaaatctccatgaactctgctaatggaagacgaggaaaaggcaggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattg

SEQ ID NO: 176598 - DNA, 1170 bp, Homo sapiens
  Payload ID: 14662
  Gene Symbol: RPL38
  Gene Name: ribosomal protein L38
  Uniprot ID: P63173
  ENST ID: ENST00000311111
  CDS Start-End: 132-344
actgcccggaaacggaagtctcgttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtctttttttttttttttttttctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctgtcagggtactgggatggggggaggtgcatgggttggggtggccaccaggtggtgctgtgccacagcgggcagcccctctggaaatgactggcatcataaaatctgtcttcatacccga

SEQ ID NO: 176599 - DNA, 431 bp, Homo sapiens
  Payload ID: 14662
  Gene Symbol: RPL38
  Gene Name: ribosomal protein L38
  Uniprot ID: P63173
  ENST ID: ENST00000439590
  CDS Start-End: 168-380
agtgcgaacgcctacatgagtcttgatcctcggcaggcaccgtacccagtttcctccgttgggagggtttaactgcccggaaacggaagtctcgttctttttcgtccttttccccggttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaa

SEQ ID NO: 176600 - DNA, 532 bp, Homo sapiens
  Payload ID: 14662
  Gene Symbol: RPL38
  Gene Name: ribosomal protein L38
  Uniprot ID: P63173
  ENST ID: ENST00000533498
  CDS Start-End: 253-465
gcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttg

SEQ ID NO: 176601 - DNA, 169 bp, Homo sapiens
  Payload ID: 14662
  Gene Symbol: RPL38
  Gene Name: ribosomal protein L38
  ENST ID: ENST00000528433
  CDS Start-End: 106-169
gcttgctgtgagtgtctctagggtgatacgtgggtgagaaaggtaatctggggcaatccactgccaggtcctggtccgcgccagagcccagcgcgcctcgtcgccatgcctcggaaaattgaggaaatcaaggacttcctgctcacagcccgacgaaaggatgccaaat

SEQ ID NO: 176602 - DNA, 429 bp, Homo sapiens
  Payload ID: 14662
  Gene Symbol: RPL38
  Gene Name: ribosomal protein L38
  ENST ID: ENST00000534490
  CDS Start-End: 91-285
cccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtgagtgagcctgaagtcacttcaggggcgggtggggtttggaaggttgctgtgtgtggccatgttgtatcttgttttgaatccctctcagatttcagagcccattttatggtctaagaatctgctcttgctgttgggagtgtgaggaatag

SEQ ID NO: 176603 - DNA, 344 bp, Homo sapiens
  Payload ID: 14662
  Gene Symbol: RPL38
  Gene Name: ribosomal protein L38
  ENST ID: ENST00000584577
  CDS Start-End: 92-295
ccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccgtgaaggaactgaaatgaaccagacacactgattggaactgtattatattaaaatactaaaaatcct

SEQ ID NO: 176604 - DNA, 401 bp, Homo sapiens
  Payload ID: 14663
  Gene Symbol: RPL39
  Gene Name: ribosomal protein L39
  Uniprot ID: P62891
  ENST ID: ENST00000361575
  CDS Start-End: 68-223
cttccgccagcttccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 176605 - DNA, 756 bp, Homo sapiens
  Payload ID: 14664
  Gene Symbol: RPL39L
  Gene Name: ribosomal protein L39-like
  Uniprot ID: Q96EH5
  ENST ID: ENST00000296277
  CDS Start-End: 404-559
atcaccgccctagcatccggggaaatcgcggtcttagcatccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaa

SEQ ID NO: 176606 - DNA, 749 bp, Homo sapiens
  Payload ID: 14664
  Gene Symbol: RPL39L
  Gene Name: ribosomal protein L39-like
  Uniprot ID: Q96EH5
  ENST ID: ENST00000433055
  CDS Start-End: 397-552
cttttcagactcagcccgcctgcacccaggtgaaataaacagccatgttgctcacacaaagcctgtttggtggtctcttcacatggacgcgcatgaaatttggtgccgtgactcagatcgggggacctcccttgggagatcaatcccctgtcctcctgttctttgctccatgagaaagatccacctacgacctcaggtcctcagacggaccagcccaaggaacatctcaccaattttaaatcagatattttgcctgtgatctatataattttatgccagaagacttggactcaagcattaagatattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaa

SEQ ID NO: 176607 - DNA, 653 bp, Homo sapiens
  Payload ID: 14664
  Gene Symbol: RPL39L
  Gene Name: ribosomal protein L39-like
  Uniprot ID: Q96EH5
  ENST ID: ENST00000455270
  CDS Start-End: 301-456
tccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaa

SEQ ID NO: 176608 - DNA, 2182 bp, Homo sapiens
  Payload ID: 14665
  Gene Symbol: RPL3L
  Gene Name: ribosomal protein L3-like
  Uniprot ID: Q92901
  ENST ID: ENST00000268661
  CDS Start-End: 96-1319
aatctgggaactggcagctgtgagtcctggccctgccactcgacctctggcggctagcggcgaggccccttcctgaccttcagggatcggccaccatgtcccaccggaagttttccgcccctcggcacggacacctgggcttcctgccccataagaggagccaccggcaccggggcaaggtgaagacgtggccgcgggatgaccccagccagcccgtgcacctcacggccttcctgggctacaaggcgggcatgacccacaccctgcgggaggtgcaccggccggggctcaaaatttccaaacgggaggaggtggaggcggtgacaattgtagaaacgccgcccctagtggtggtgggcgtggtgggctacgtggccacccctcgaggtctccggagcttcaagaccatctttgcagaacacctcagtgatgagtgccggcgccgattctacaaggactggcacaagagcaagaagaaagccttcaccaaggcctgcaagaggtggcgggacacagacgggaaaaagcagctacagaaggacttcgccgccatgaagaagtactgcaaggtcattcgggtcattgtccacactcagatgaaactgctgcccttccggcagaagaaggcccacatcatggagatccagctgaacggtggcacggtggccgagaaggtggcctgggcccaggcccggctggagaagcaggtgcccgtgcacagcgtgttcagccagagtgaggtcattgatgtcattgctgtcaccaagggtcgaggcgtcaaaggggtcacaagccgctggcataccaagaagctgccgcggaagacccataagggcctgcgcaaggtggcctgcattggcgcctggcaccccgcccgcgtgggctgctccattgctcgggccgggcagaagggctatcaccaccgcacggagctcaacaagaagatcttccgcatcggcaggggcccgcacatggaggacgggaagctggtgaagaacaatgcatccaccagctacgacgtgactgccaagtccatcacaccgctgggtggcttcccccactacggggaagtgaacaacgacttcgtcatgctgaagggttgtattgctggtaccaagaagcgggtcattacgctgagaaagtccctcctggtgcatcacagtcgccaagccgtggagaatattgagctcaagttcattgacaccacctccaagttcggccatggccgcttccagacagcccaagagaagagggccttcatgggcccccaaaagaagcatctggagaaggaaacgccggagacctcgggagacttgtaggctgtgtggggtggatgaaccctgaagcgcaccgcactgtctgccccaatgtctaacaaaggccggaggcgactcttcctgcgaggtctcagagcgctgtgtaaccgcccaaggggttcaccttgcctgctgcctagacaaagccgattcattaagacaggggaattgcaatagagaaagagtaattcacacagagctggctgtgcgggagaccggagttttatgttttattattactcaaatcgatctctttgagcatttgcggagcagaggttttttttttttttttttttgagagagtcttgatcttgtcgcccaggctgctggagtgccggggagcagagtttttaaggataacttggcgggtggggagagccagtgagccaggagagccgattggtcagggaggaaatcacagggagtcagctgtcttcttgcgctgagtcagctcctgggtggtggccacaagatcagatgagccagtttatcaatctggttggtgccagcagatccatcaagttgcagggtcggcaaaatatctcaagcactgatcttaggggcagcttagggagggtcagaatcttgtagcctccagatgcacgactcctaaaccataattcccaatattgtggctaatgttagtcctaaaaatgcaatctagtccccaggcaaggaggtggtctgctttgggaaagggctgttactgtctttgttttaaactataaactggctgggcgcggtggctcacgcctgtaatcccagcactttgggaggccaagatgggcggatcacctgaggtcgggagttcaagaccagcctggccaacatcgagaaacctcgtctctattaaaaatacaaaatta

SEQ ID NO: 176609 - DNA, 575 bp, Homo sapiens
  Payload ID: 14665
  Gene Symbol: RPL3L
  Gene Name: ribosomal protein L3-like
  ENST ID: ENST00000565426
  CDS Start-End: 447-575
gaagccagtgagattacgagcccactggcaggatgaacaactccagacgcgcggcgccttaagagctgtaacaccgcgaaggtctgtagcttcattcctgagctagcgagagcgcgaacctaccagaaggaagaaactccgaacacatcggaacatcagaacgagcaaactccggacaccccgcctttaggaactgcaacactcaccgcgagggtccgtggcttcattcttgaagtcagtgagaccaagaactcaccaattccggacacaacaggatctacggtcacagaaactcccaccggaagttttccgcccctcggcacggacacctgggcttcctgccccataagaggagccaccggcaccggggcaaggtgaagacgtggccgcgggatgaccccagccagcccgtgcacctcacggccttcctgggctacaaggcgggcatgacccacaccctgcgggaggtgcaccggccggggctcaaaatttccaaacgggaggaggtggaggcggtgacaattgtagaaacgccgcccctagtggtggtgggcgtggtgggctacgtggccacc

SEQ ID NO: 176610 - DNA, 2769 bp, Homo sapiens
  Payload ID: 14666
  Gene Symbol: RPL4
  Gene Name: ribosomal protein L4
  Uniprot ID: P36578
  ENST ID: ENST00000307961
  CDS Start-End: 94-1377
ggaaggtgacatatacagcgggagtggtaagcacttccttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgacttggtgtgctctgtaaagcttggttagaatttttttaaagtgacattttgttggccataatttagactgttacattttatatagtgtggtataaaatggggcatggatttatactaagtccatggagttcagtggaaggggaatgatttaaaaaaagttgtggttttctaaataatgtggcttgaaaaataggtgtaacaggacttggtcagaaacgcagaggctgttcaagtttagctccccaccagatggaaaataggttaaattctgtaaagatttaactttaaccacaagagggcacaactggagagcacaatttttttggtactgcagtaaaattgattacctcttgagaagtgttctttttaaccagctataacaatagagttgagtattttcacccatggtttgaaaaagtgccagaaggccacactggcccacatctgtaatcccaacactttgggaccctaaggtgggcagagcacttgagccaatgagttcaagaccagcctggtcaacatgatgaaatctcgtctctactgaaaatataaaaaatagccagtcatggtgcatgcctgtaaccccagctacttggaggctgaggcaagagaatcacttgaacctgggaggtggaggttgcaatgagccaagattgtaccattgccctccagcctgggcgtcagagcaagactctctgaaaagtaccagaagcatttttcaggactgcctgtgtgtcttggtgattatgttaaccaactgtgttcaaaagaagtacccatgaaatgcctccagatataagggtgtttttttttacccataaagctaaactgcaaatattaccctagaattaacctcttgtcctgtgtcaaaagtcttgttttgcatctggattgttaaactgtcagcttctctctgacagtctcgaactgtcaagacagtctcagttcacagccaaggtgatctgttaaccctccccatttccagggccaaatctcagttcttaagcacgtcgtttcttagcacggctttattttcatgctctttatttctctattttgtgcagccttacccctttaaagtccactgtgagtcctaccctgcagggcctcttaacacagtagagttcatgtgctactgatttggtgcctgccttcaaacacatgtgcaagttttgtggggttaaagatagccacttggtggcacaccacattggaagtgctgttcacccggtcatttgaaacggtgtttgaccacttggtgcgcaaatggcctatcggattaaaggatagccaaacccaa

SEQ ID NO: 176611 - DNA, 1864 bp, Homo sapiens
  Payload ID: 14666
  Gene Symbol: RPL4
  Gene Name: ribosomal protein L4
  ENST ID: ENST00000568588
  CDS Start-End: 779-1780
gcataccaggtagatcaagatgcacacaccagaagatgatagagtatgacaggatccgagctacaagcaaggagcttggagtcaacaaggctttaaacaggggaaggatgccaacacctagttttccgtatcccgggtggtgcctctacttatggcaagtgtgtccatcagcagaaagaataaatcgcctcttggaacacttgccaccttccatctcgtttgatgacgtacacgttttctcctgagacaagcaagctcccacacggtcaaccccacaccggagccgagaaccggcctctccccaactcctggaccccaggaaagctggcaaagcgctgatccccagagtggcaagaggcttagggcggggatccagacacccagggaaagaagtgctgtcccaggaccccagccaaaagaagagactagactcactgaaggagacgagaataaaagtcctctgctgcgcagttcagccgctcccacatcccgccccaatgcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgag

SEQ ID NO: 176612 - DNA, 565 bp, Homo sapiens
  Payload ID: 14666
  Gene Symbol: RPL4
  Gene Name: ribosomal protein L4
  ENST ID: ENST00000569438
  CDS Start-End: 56-565
ttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaagttgaagataaagttgaaggctacaagaagaccaaggaagctgttttgctccttaagaaacttaaagcctggaatgatatcaaaaaggtc

SEQ ID NO: 176613 - DNA, 569 bp, Homo sapiens
  Payload ID: 14666
  Gene Symbol: RPL4
  Gene Name: ribosomal protein L4
  ENST ID: ENST00000569696
  CDS Start-End: 57-569
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagaaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgca

SEQ ID NO: 176614 - DNA, 469 bp, Homo sapiens
  Payload ID: 14667
  Gene Symbol: RPL41
  Gene Name: ribosomal protein L41
  Uniprot ID: P62945
  ENST ID: ENST00000501597
  CDS Start-End: 84-161
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 176615 - DNA, 699 bp, Homo sapiens
  Payload ID: 14667
  Gene Symbol: RPL41
  Gene Name: ribosomal protein L41
  Uniprot ID: P62945
  ENST ID: ENST00000546591
  CDS Start-End: 203-280
cgacacccggcgctccattaaatagccgtagacggaacttcgcctttctctcggccttagcgccatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcatcttgtctattatgttttttatggttccatcgggtgggggttttctgtcattagagtttgccctgtcactacctgtgctatggagggtatcaaagctataaaggcaacagc

SEQ ID NO: 176616 - DNA, 681 bp, Homo sapiens
  Payload ID: 14668
  Gene Symbol: RPL5
  Gene Name: ribosomal protein L5
  ENST ID: ENST00000315741
  CDS Start-End: 291-681
cgcaggatggtgagtggatgcctcggtctcggggctttagatgcatggaggttcccttttcttgcccgtatgccagcctagggcccgtctcgcgcgtcgcaggggccggatggcgttagattgctagctctgacttggtcgaggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattcc

SEQ ID NO: 176617 - DNA, 1043 bp, Homo sapiens
  Payload ID: 14668
  Gene Symbol: RPL5
  Gene Name: ribosomal protein L5
  Uniprot ID: P46777
  ENST ID: ENST00000370321
  CDS Start-End: 91-984
cgcaagggctgtggcccttttcccaccccctagcgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaacta

SEQ ID NO: 176618 - DNA, 694 bp, Homo sapiens
  Payload ID: 14668
  Gene Symbol: RPL5
  Gene Name: ribosomal protein L5
  ENST ID: ENST00000470843
  CDS Start-End: 52-243
tgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagtaggtctagaattggaacctgggaacttggtactttaaaaaatgctcttggttgcgctcatgcctgtaatcccagcacttcgggaagattgcttgagcccaggagtttgagaccagcctgggcaatatagtgagagtttgtcttcacaaaaaatattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctg

SEQ ID NO: 176619 - DNA, 947 bp, Homo sapiens
  Payload ID: 14669
  Gene Symbol: RPL6
  Gene Name: ribosomal protein L6
  Uniprot ID: Q02878
  ENST ID: ENST00000202773
  CDS Start-End: 56-922
atgattgcttatagaccggaagccgggaccttaattctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatag

SEQ ID NO: 176620 - DNA, 1074 bp, Homo sapiens
  Payload ID: 14669
  Gene Symbol: RPL6
  Gene Name: ribosomal protein L6
  Uniprot ID: Q02878
  ENST ID: ENST00000424576
  CDS Start-End: 187-1053
atcttgcaaggtaagaatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagaggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaa

SEQ ID NO: 176621 - DNA, 612 bp, Homo sapiens
  Payload ID: 14669
  Gene Symbol: RPL6
  Gene Name: ribosomal protein L6
  ENST ID: ENST00000548343
  CDS Start-End: 297-612
aaataatggttgtacggacttctgaccgctcagtatttggcaaaaaacctaataggtgtgaggtagtttcaaattctcaaaaaaaaagtttatagtgtattggggagacaaaccccaaatgagtcatagtgaaggttggagtagaatgggtagagtttgagaggaaggcctgtatcttaccgggggagggattgtagtctggggagcccagcccattcatgtacaggttcattattgtcttgttagagagatgactggtgaaatgcctttttttatctacaaaaaaatatttttagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccggg

SEQ ID NO: 176622 - DNA, 588 bp, Homo sapiens
  Payload ID: 14669
  Gene Symbol: RPL6
  Gene Name: ribosomal protein L6
  ENST ID: ENST00000549847
  CDS Start-End: 110-588
ttagaggaagcggggagacggcgcgtgcactgtgttcctggtcctgggttccagaggatgacactgagcctgtcgcagccacgttggggttccgcactgaagccaaaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaa

SEQ ID NO: 176623 - DNA, 700 bp, Homo sapiens
  Payload ID: 14669
  Gene Symbol: RPL6
  Gene Name: ribosomal protein L6
  ENST ID: ENST00000551291
  CDS Start-End: 340-700
gtcagcggaggaccgagcgacggccgggaatggcagcgcgggggctccgcggaggcgccacgcacagtgtccaaagcatccttgcttcctcctggaaaccgcggccgccagtgaatcagaaccagaaaaaggctaaatgattcccagagacacagccatgaagcaggtggtttcgatctgaaaaaatcaaggtgaaaagctctagcaaccagaaagaaacgaatggaggaaaatggaaaacgcaagctagaagacagagtctcattctgtaggccaggccggaggacgggaatgagaaaggccatgtacaagaggaagtagtcagccgctaaatccaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatg

SEQ ID NO: 176624 - DNA, 338 bp, Homo sapiens
  Payload ID: 14669
  Gene Symbol: RPL6
  Gene Name: ribosomal protein L6
  ENST ID: ENST00000550238
  CDS Start-End: 148-338
ggaatgagaaaggccatgtacaagaggaagtagtcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgt

SEQ ID NO: 176625 - DNA, 438 bp, Homo sapiens
  Payload ID: 14669
  Gene Symbol: RPL6
  Gene Name: ribosomal protein L6
  ENST ID: ENST00000553213
  CDS Start-End: 83-438
ggcctgtctgcaagacttgagttcaggactcccaatccttcgccatccgaacctggagggcatccagtcgacacctacagggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactga

SEQ ID NO: 176626 - DNA, 1014 bp, Homo sapiens
  Payload ID: 14669
  Gene Symbol: RPL6
  Gene Name: ribosomal protein L6
  ENST ID: ENST00000550566
  CDS Start-End: 535-1014
ggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagagggtgaggtagaatgccgtagtggctccctccggttcttcgccactctcttgggctgggggaacgaggccctttcggggacccgtagcagactggtgggtgttagaggaagcggggagacggcgcgtgcactgtgttcctggtcctgggttccagaggatgacactgagcctgtcgcagccacgttggggttccgcactgaagccaaaaggtttcgcgtctcccagcgtccccgaccggaagtcgcctcttggtctttgcgatctttttctctggctcaatttgggctgattccgtttgtgtccgcaattcctaaatcgagtttcttgaaaagagacactggtcttaagggttaagacgaaaggtactgaaaatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaag

SEQ ID NO: 176627 - DNA, 1101 bp, Homo sapiens
  Payload ID: 14670
  Gene Symbol: RPL7
  Gene Name: ribosomal protein L7
  Uniprot ID: P18124
  ENST ID: ENST00000352983
  CDS Start-End: 287-1033
gcagcctggggattaggacccggagttgccaaggtgtcagcactctttgctcttgaattgattaaaaagtctaatcaaatgcatatattttcttcaaacaagttttacccgaaagtttgttgaaagaggctaaatcagggagttctttgcgtctgcaaggcggctttttagttctggattcttttccggcttattctaagacacctatgagtcgtggggcttctctcgcgaagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaata

SEQ ID NO: 176628 - DNA, 1308 bp, Homo sapiens
  Payload ID: 14670
  Gene Symbol: RPL7
  Gene Name: ribosomal protein L7
  ENST ID: ENST00000396465
  CDS Start-End: 680-1306
ccctctcacacggccgtggccgcaacctcagccctcctcgcacctcccttcgcagctcacgccccctcccgtggggtgtcctggcctccgcctgccgagctcggcagtcagcagagccccggccatcctcctccggccgtccggtccccactggtccctggctagccacttttcgtaagctagagcactccagaccgccccgcctgcgatcaggcgctgcggaagacagccctgtgggctggagcgacgacaaggacctcgcggagcggcgaaaggggtgtagtctgcgactaccgcggcagggagccgggagggcggccaaaagtgacttcgaattgcagctagccgtttggaacgtggcccaagaggctctcattttcctggctggaaccgtcgccgcggtgcttgcctgcggtcctggtcagccgttgccctcccgccgggcgggcgaagactggtgcatgctgggatttgtagttcgtccccatgaggctcgtcctgggaacattatggggaggaacggagcctaatcctgtcagcgcagcctggggattaggacccggagttgccaagagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaagg

SEQ ID NO: 176629 - DNA, 762 bp, Homo sapiens
  Payload ID: 14670
  Gene Symbol: RPL7
  Gene Name: ribosomal protein L7
  ENST ID: ENST00000396466
  CDS Start-End: 132-758
gcgaggacagggcaccttctccctgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtg

SEQ ID NO: 176630 - DNA, 1526 bp, Homo sapiens
  Payload ID: 14670
  Gene Symbol: RPL7
  Gene Name: ribosomal protein L7
  ENST ID: ENST00000396467
  CDS Start-End: 140-766
cctctttttccggctggaaccatggagggtgtagaagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgagagacctcatcctgagaaaggttgagttaatgttagagtataagtggtggtaatcttgaatacttttcccattaaatattgatgggggtttgaattttaatcagtgcttttgtggggagtgggggtcaactatcttaatgattacagttggtttgtttactgcttttgaggacctttctggaggaaaggaaaagcctgttttggggagtctttaaagatggaaattgggtggtcttaaaaatgtaaactcaatcattactttataactgcctagtttatgttaattgttagctgcctaaagtgttttctaatggttttcttttttcctttcaggtgtctaccatgattatttttctaagctggttggttaataaacagtacctgctctcaaattgaaatatattgttgtatttgtgatttgttgttgttgttgttagcctgcctctgtcttcccttaactactgtggcaagtgtggtgtgtgataaaattaagccaaatcaacagcccatttcgtgcaaaatcagggtcgagtctgtgtgaaagacatctcttgggtttttaaaaggcttttctatacaaaagattttaattttttgttttttaactgtgctgagtgattcgaaatgggtttattctaagaaagcctgtttcacaagcatttgtacatgatttgtcggtaaggtaatccaactttggtttatggaaaaaattgaatttagttgctaaaatttatttctcgggccttcgcttgttt

SEQ ID NO: 176631 - DNA, 563 bp, Homo sapiens
  Payload ID: 14670
  Gene Symbol: RPL7
  Gene Name: ribosomal protein L7
  ENST ID: ENST00000431653
  CDS Start-End: 299-563
agtcctcggtagagggtctttcgggggaggcgcagaacctctgaattgtgttcgtccttggctggtgcttggtacaggcctccctgccgccaggcctttgctttcaacatgtggatcctgattgaaccagagtggtggtggcttgttttttttttatttttattttttaatttttgcgcttaaagtctcgggagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggctt

SEQ ID NO: 176632 - DNA, 445 bp, Homo sapiens
  Payload ID: 14670
  Gene Symbol: RPL7
  Gene Name: ribosomal protein L7
  ENST ID: ENST00000435330
  CDS Start-End: 148-445
agtaaagttactagtgactaaagtcagtgacagcatttctgagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatata

SEQ ID NO: 176633 - DNA, 680 bp, Homo sapiens; identical to SEQ ID NO: 102964
  Payload ID: 14671
  Gene Symbol: RPL7A
  Gene Name: ribosomal protein L7a
  ENST ID: ENST00000315731
  CDS Start-End: 165-620

SEQ ID NO: 176634 - DNA, 891 bp, Homo sapiens; identical to SEQ ID NO: 102965
  Payload ID: 14671
  Gene Symbol: RPL7A
  Gene Name: ribosomal protein L7a
  Uniprot ID: P62424
  ENST ID: ENST00000323345
  CDS Start-End: 31-831

SEQ ID NO: 176635 - DNA, 1057 bp, Homo sapiens; identical to SEQ ID NO: 102963
  Payload ID: 14671
  Gene Symbol: RPL7A
  Gene Name: ribosomal protein L7a
  ENST ID: ENST00000426651
  CDS Start-End: 483-1057

SEQ ID NO: 176636 - DNA, 3769 bp, Homo sapiens
  Payload ID: 14672
  Gene Symbol: RPL7L1
  Gene Name: ribosomal protein L7-like 1
  Uniprot ID: Q6DKI1
  ENST ID: ENST00000304734
  CDS Start-End: 257-997
gtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagtttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagtgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcatgatctcagctcattgcagcctccacctcctgggttcaagtgattctgcctcagccccttgatcagctgggattacatgcatgtaccaccacacccagctaattcttgtatttttagtagagatggagacagagtttcaccatgtaggccaggctagtctcaaactcctgacctcaagtgatccacaagcctgggcctcccaaagtgctgggattacaggcatgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacacctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttacaaaaattgcgcacttatatgtatgtaccatgacataactaa

SEQ ID NO: 176637 - DNA, 4476 bp, Homo sapiens
  Payload ID: 14672
  Gene Symbol: RPL7L1
  Gene Name: ribosomal protein L7-like 1
  Uniprot ID: Q6DKI1
  ENST ID: ENST00000493763
  CDS Start-End: 304-1044
ataggtgcattgtgggaagcactttgctgtccacagccaggccgcttgtgatgaaactgtaacttacaagaaaagggctgggttttgaaaataacacaggctctaaaaaccctaagaagcggtgcaacttttggcaggaatcggggttagcgggacctcaagggctcactgcggctaagtgaacgctgactggtcctccagcgtgagctagaacagacgtctctatggtcaagtaaacagagcgtgtgctgtcttccccatgtggtggggttgcgcatgatcagtagctgcaccactagaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggggaagtttggcgtcatttgcttggaagacctcattcatgaaattgccttcccagggaagcatttccaggagatctcatggttcttgtgccctttccacctctcagtggcccgtcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaatagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcgcgtgcctgtagtcccagctactcgagaggctaaggcaggaaaatcgcttgaacccaggaggcagagattgcagtgagccaagattgcaccagtgcactccagctgggcgacagagcgagactccatctcggaaaaaaaaaaaaaaaaactattgctgcagtcattcagatggaaatgaggaaagaataatattaataactgatttcaaaaaggacttgaagatgtgaatcatctattttgctgaagaaatcttaactctttgaaattactttttattgctgttgtcatactcttaggtgccaaactgcggtaaattttttatcagtgaagtggaagcatgtgttttgttttggaaatttttatcaagtatcttcagagaagattatttcctgctttatcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcatatgttcatgtcaagcacctctcatcacagtcgagttccaaggaaaaattccagtgttttctgcattgggtgctgtgtcatctgaaatcggcacattccatggaggaaggagtcctgctttgttgcatgtatcctagggtttaatgttggtaaatgagtcactctagcatttgtagaaggctccctgagactcctgcagcagtcgaccaagcccaaggacataattgaatctggagagtcctggggccttgttttgaaaaagacttgaaatacacataggaagaaaggcataaaaataaatgttcacttgtctctgctgtgagtatgtgttccaacttttcagtgatggctttgagaattctcaaacttgactggctctaagtgtatctggtggcttttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcatgatctcagctcattgcagcctccacctcctgggttcaagtgattctgcctcagccccttgatcagctgggattacatgcatgtaccaccacacccagctaattcttgtatttttagtagagatggagacagagtttcaccatgtaggccaggctagtctcaaactcctgacctcaagtgatccacaagcctgggcctcccaaagtgctgggattacaggcatgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacacctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttataattgtatacaaataaaagatgttacaaaaattgcgca

SEQ ID NO: 176638 - DNA, 703 bp, Homo sapiens
  Payload ID: 14672
  Gene Symbol: RPL7L1
  Gene Name: ribosomal protein L7-like 1
  ENST ID: ENST00000602561
  CDS Start-End: 6-596
gaaagatggcggagcaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctgggtgagtgctacagcttagggatcagctggggcagaaagccagggtctttgaagctttgatgtgagattcaggttgtattcttcttggggccccaagagtctgccagagtggccagcttagtatatgctggatacatgttaaataaaggaatctgtgcttttgtgtt

SEQ ID NO: 176639 - DNA, 1041 bp, Homo sapiens
  Payload ID: 14673
  Gene Symbol: RPL8
  Gene Name: ribosomal protein L8
  Uniprot ID: P62917
  ENST ID: ENST00000262584
  CDS Start-End: 234-1007
accaggacaccttcagccgcgtctcctggtgcgcctgcgcgggggccctggaggaggagaagtaggcggggccggcggccgctggtgactacaagccccggcgtgcaccgcgctaggctggccgtggcgcgcccggaaggtgtcgcggccctgggccccgccccggaagataaggccgctcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 176640 - DNA, 965 bp, Homo sapiens
  Payload ID: 14673
  Gene Symbol: RPL8
  Gene Name: ribosomal protein L8
  Uniprot ID: P62917
  ENST ID: ENST00000394920
  CDS Start-End: 157-930
tctttcggccgcgctggtgaacaggtaggtcatccttgcggccttgcggcatgggcagtatccgccgccatcctcttccgtgaggcgcgctgagacccggaccggccctcctgagaggatgccggtgcgggcgcccgcggagagggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcca

SEQ ID NO: 176641 - DNA, 1015 bp, Homo sapiens
  Payload ID: 14673
  Gene Symbol: RPL8
  Gene Name: ribosomal protein L8
  Uniprot ID: P62917
  ENST ID: ENST00000528957
  CDS Start-End: 223-996
cggccttgcggcatgggcagtatccgccgccatcctcttccgtgaggcgcgctgagacccggaccggccctcctgagaggatgccggtgcgggcgcccgcggagagggtagggagtggtgggcgcggcggcctcgggggcggggtcccggaaagccgggctggcgggggtacccgggccgcccggccgcgctaatcgtgagtcgcccccaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaa

SEQ ID NO: 176642 - DNA, 876 bp, Homo sapiens
  Payload ID: 14673
  Gene Symbol: RPL8
  Gene Name: ribosomal protein L8
  ENST ID: ENST00000529920
  CDS Start-End: 15-518
caggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggttgagtggccggcctgacgtctcacacatggtgaggggggtgcttccctgcgcttggagctcagccagcattctaggtgatggaggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtg

SEQ ID NO: 176643 - DNA, 745 bp, Homo sapiens
  Payload ID: 14673
  Gene Symbol: RPL8
  Gene Name: ribosomal protein L8
  ENST ID: ENST00000532702
  CDS Start-End: 131-745
cggccgcgctggtgaacaggtaggtcatccttgcggccttgcggcatgggcagtatccgccgccatcctcttccgtgaggcgcgctgagacccggaccggccctcctgagaggatgccggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaat

SEQ ID NO: 176644 - DNA, 730 bp, Homo sapiens
  Payload ID: 14673
  Gene Symbol: RPL8
  Gene Name: ribosomal protein L8
  ENST ID: ENST00000533397
  CDS Start-End: 25-730
gagtcgcccccaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagaga

SEQ ID NO: 176645 - DNA, 551 bp, Homo sapiens
  Payload ID: 14673
  Gene Symbol: RPL8
  Gene Name: ribosomal protein L8
  ENST ID: ENST00000527914
  CDS Start-End: 70-516
ggaagataaggccgctcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcca

SEQ ID NO: 176646 - DNA, 698 bp, Homo sapiens
  Payload ID: 14673
  Gene Symbol: RPL8
  Gene Name: ribosomal protein L8
  ENST ID: ENST00000531975
  CDS Start-End: 1-331
ggcgctgcgcgcctgcgcgccgtggatttcgctgagcggcacggctacatcaagggcatcgtcaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccacct

SEQ ID NO: 176647 - DNA, 750 bp, Homo sapiens
  Payload ID: 14674
  Gene Symbol: RPL9
  Gene Name: ribosomal protein L9
  Uniprot ID: P32969
  ENST ID: ENST00000295955
  CDS Start-End: 60-638
acgcgatacaagtacgtaatgacgacagacgttctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaccttcttcttaaa

SEQ ID NO: 176648 - DNA, 1127 bp, Homo sapiens
  Payload ID: 14674
  Gene Symbol: RPL9
  Gene Name: ribosomal protein L9
  Uniprot ID: P32969
  ENST ID: ENST00000449470
  CDS Start-End: 450-1028
aaggatgtttctgtgctcgtgggggtactgggaatctgaaaccatctgctctgggaaaggctgcggcgcggctcccactctcggaaccttgtcctgtttgtcccccagctcggcaagcgccatatgagcctggcggcgccagatgcgaatcctgttgtgggctttttggcctattcccgcccctcagtcttgccgggatggcaccgcccgcataggacttccagggttgggctgagtgggagttcgactgctgggcctcgtaattctcgctttggggctgctccttccaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgga

SEQ ID NO: 176649 - DNA, 571 bp, Homo sapiens
  Payload ID: 14674
  Gene Symbol: RPL9
  Gene Name: ribosomal protein L9
  ENST ID: ENST00000503040
  CDS Start-End: 27-571
ctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgt

SEQ ID NO: 176650 - DNA, 689 bp, Homo sapiens
  Payload ID: 14674
  Gene Symbol: RPL9
  Gene Name: ribosomal protein L9
  ENST ID: ENST00000504470
  CDS Start-End: 192-689
agacgttctttctttgctgcgtctactgcgaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaaca

SEQ ID NO: 176651 - DNA, 371 bp, Homo sapiens
  Payload ID: 14674
  Gene Symbol: RPL9
  Gene Name: ribosomal protein L9
  ENST ID: ENST00000506581
  CDS Start-End: 1-274
gctccgggttgacaaatggtggggtaacagaaaggaactggctaccgttcggactatttgtagtcatgtacagaacatgatcaagggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttg

SEQ ID NO: 176652 - DNA, 667 bp, Homo sapiens
  Payload ID: 14674
  Gene Symbol: RPL9
  Gene Name: ribosomal protein L9
  ENST ID: ENST00000508595
  CDS Start-End: 1-568
gacagacgttctttctttgctgcgtctactgcgagtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgga

SEQ ID NO: 176653 - DNA, 644 bp, Homo sapiens
  Payload ID: 14675
  Gene Symbol: RPS10
  Gene Name: ribosomal protein S10
  Uniprot ID: P46783
  ENST ID: ENST00000326199
  CDS Start-End: 95-592
ggcggggggcgggtccacgccagcccggaagagacgcagcaccgcgcatgctccttcctttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaa

SEQ ID NO: 176654 - DNA, 650 bp, Homo sapiens
  Payload ID: 14675
  Gene Symbol: RPS10
  Gene Name: ribosomal protein S10
  ENST ID: ENST00000344700
  CDS Start-End: 1-519
atgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttgtcctcatagcacacgattgctctcagataatgtcatttgtaaaaaggaagcatgtacagtagaaacggtccaatcctggtgctggatgctttcataggaagaggcggatttggtcgtggacgtggtcagccacctcagtaaaattggagaggattcttttgcattgaataaacttacagccaaaaaaccttaa

SEQ ID NO: 176655 - DNA, 784 bp, Homo sapiens
  Payload ID: 14675
  Gene Symbol: RPS10
  Gene Name: ribosomal protein S10
  Uniprot ID: P46783
  ENST ID: ENST00000621356
  CDS Start-End: 247-744
agccgcagaggtgagtttctgtggcgttcgagttccatcggctcccatccgggctatcctgccgccttagcggctgcttctccccaggatgcgggcagggggcctctctcccactccccacacaccgatttctgagtagcgataggggctggaggcttattttatggggtagggggccgctggtaggcgaagattgtccgagggagagggggaggatgaagccagtgagtggcggagacttgccagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagcc

SEQ ID NO: 176656 - DNA, 614 bp, Homo sapiens
  Payload ID: 14676
  Gene Symbol: RPS11
  Gene Name: ribosomal protein S11
  Uniprot ID: P62280
  ENST ID: ENST00000270625
  CDS Start-End: 84-560
gtcacttcctctccagcccctgcgtaatcgataaggaaacccggacgctgctgcccctttctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccca

SEQ ID NO: 176657 - DNA, 547 bp, Homo sapiens
  Payload ID: 14676
  Gene Symbol: RPS11
  Gene Name: ribosomal protein S11
  ENST ID: ENST00000601306
  CDS Start-End: 1-249
attcaggtgcggactcggggttggatgccaggactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccc

SEQ ID NO: 176658 - DNA, 583 bp, Homo sapiens
  Payload ID: 14676
  Gene Symbol: RPS11
  Gene Name: ribosomal protein S11
  ENST ID: ENST00000596873
  CDS Start-End: 26-382
ttctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcaggtgagcgcagtggcccatcaggttgctcaggccacgctctctcagccttcagattccagatcggaccaatttaaggccaactgagggagggaaagactgaggtggcatctctgggaagccccagaatctcaggatttgtatatcatatgttcttcagaatcaaagcgttctacagggtgaatatctctacctgaaatgcttggaa

SEQ ID NO: 176659 - DNA, 575 bp, Homo sapiens
  Payload ID: 14676
  Gene Symbol: RPS11
  Gene Name: ribosomal protein S11
  ENST ID: ENST00000594493
  CDS Start-End: 282-521
ctttttttcaggcggccgggaagatggcggacattcagttttctcctcataatctgtagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccca

SEQ ID NO: 176660 - DNA, 430 bp, Homo sapiens
  Payload ID: 14676
  Gene Symbol: RPS11
  Gene Name: ribosomal protein S11
  ENST ID: ENST00000599561
  CDS Start-End: 4-270
aagatggcggacattcagactgagcgtgcctaccaaaagcagccgaccatctttcaaaacaagaagagggtcctgctgggagaaactggcaaggagaagctcccgcgggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccca

SEQ ID NO: 176661 - DNA, 631 bp, Homo sapiens
  Payload ID: 14677
  Gene Symbol: RPS12
  Gene Name: ribosomal protein S12
  Uniprot ID: P25398
  ENST ID: ENST00000230050
  CDS Start-End: 211-609
gcctcaatccggaaacagaaactccccaggcccggcactgcgggagccacctctttcgagggtgggagtgcacatgcgcacaggggacctgaaaaacccttaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 176662 - DNA, 491 bp, Homo sapiens
  Payload ID: 14678
  Gene Symbol: RPS13
  Gene Name: ribosomal protein S13
  ENST ID: ENST00000228140
  CDS Start-End: 26-472
ctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 176663 - DNA, 355 bp, Homo sapiens
  Payload ID: 14678
  Gene Symbol: RPS13
  Gene Name: ribosomal protein S13
  ENST ID: ENST00000533969
  CDS Start-End: 7-355
gccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcgtcttgctcttgtcgcccagtctggagtgcagtggcgcgatctcagctcactgcaacctccacctcctggattcaagcgattctcctgcctcagcctcccgaataggtgtaatcctgagagattcacatggtgttgcacaagtacgttttgtgacaggcaataaaattttaagaattcttaagtctaagggacttgctc

SEQ ID NO: 176664 - DNA, 646 bp, Homo sapiens
  Payload ID: 14678
  Gene Symbol: RPS13
  Gene Name: ribosomal protein S13
  Uniprot ID: P62277
  ENST ID: ENST00000525634
  CDS Start-End: 147-602
cacacagacgggcggtggctgcgcagcgtagctccgcctcctgcgtgagaggaagcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 176665 - DNA, 711 bp, Homo sapiens
  Payload ID: 14679
  Gene Symbol: RPS14
  Gene Name: ribosomal protein S14
  Uniprot ID: P62263
  ENST ID: ENST00000312037
  CDS Start-End: 208-663
ggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgctttcagggaggagcttgtgaaaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaa

SEQ ID NO: 176666 - DNA, 784 bp, Homo sapiens
  Payload ID: 14679
  Gene Symbol: RPS14
  Gene Name: ribosomal protein S14
  Uniprot ID: P62263
  ENST ID: ENST00000407193
  CDS Start-End: 274-729
ctccgccccctcccactctctctttccggtgtggagtctggagacgacgtgcaggtaggaggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgctttcagggaggagcttgtgaagtaaggaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttc

SEQ ID NO: 176667 - DNA, 1599 bp, Homo sapiens
  Payload ID: 14679
  Gene Symbol: RPS14
  Gene Name: ribosomal protein S14
  Uniprot ID: P62263
  ENST ID: ENST00000401695
  CDS Start-End: 48-503
ctcccactctctctttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtacccta

SEQ ID NO: 176668 - DNA, 592 bp, Homo sapiens
  Payload ID: 14679
  Gene Symbol: RPS14
  Gene Name: ribosomal protein S14
  Uniprot ID: P62263
  ENST ID: ENST00000521466
  CDS Start-End: 84-539
gttaacgcactgggtcgtgctcattggtctgatttgaagataggaacatttaacttcgtacacccaagacttacacttgaaaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtt

SEQ ID NO: 176669 - DNA, 398 bp, Homo sapiens
  Payload ID: 14679
  Gene Symbol: RPS14
  Gene Name: ribosomal protein S14
  ENST ID: ENST00000519855
  CDS Start-End: 1-362
ggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattggtaagtgcccccctctagctaatgcttgggtttattttgaagcattggccccaaaaagcacgtgctgtgcccagtggatgtgcagcggctggtctggtcacttttggcagttaagtttgttaagggaggctgcaagaggcaccttgtgacttaaaaatctctccctgaatatctctgtcaccttg

SEQ ID NO: 176670 - DNA, 669 bp, Homo sapiens
  Payload ID: 14679
  Gene Symbol: RPS14
  Gene Name: ribosomal protein S14
  ENST ID: ENST00000518139
  CDS Start-End: 3-407
aaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgagaagacggtgggctagatgtcagaacctggatttgtcctgtgcctctgacatcttgcgcacagctcagcctgtttccctttctggaaagtgagttaagaccacgtcaggaaattcgaggaactggcagatggggccacttcatgttcacatccatctgttagaggatgtcacccccatcccctctgacagcactcgcaggaaggggggtcgccgtggtcgccgtctgtgaacaagattcctcaaaatattttctgttaataaattgccttcatgtaaa

SEQ ID NO: 176671 - DNA, 570 bp, Homo sapiens
  Payload ID: 14680
  Gene Symbol: RPS15
  Gene Name: ribosomal protein S15
  ENST ID: ENST00000586096
  CDS Start-End: 6-395
gcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaaggtgtgtgcggccgtccctgccggctggggtgggctggggtcgcctgatgcaggcgggatcagctgacacccagctttgctcttggtctcccgcagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 176672 - DNA, 629 bp, Homo sapiens
  Payload ID: 14680
  Gene Symbol: RPS15
  Gene Name: ribosomal protein S15
  ENST ID: ENST00000593052
  CDS Start-End: 139-597
cggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 176673 - DNA, 467 bp, Homo sapiens
  Payload ID: 14680
  Gene Symbol: RPS15
  Gene Name: ribosomal protein S15
  ENST ID: ENST00000585665
  CDS Start-End: 97-435
caagatggcagaagtagagcagaagaagaagcggaccttccgcaagttcacctaccgcggcgtggacctcgaccagctgctggacatgtcctactgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 176674 - DNA, 510 bp, Homo sapiens
  Payload ID: 14680
  Gene Symbol: RPS15
  Gene Name: ribosomal protein S15
  Uniprot ID: P62841
  ENST ID: ENST00000592588
  CDS Start-End: 41-478
aggcgcggaccaaagcgatctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 176675 - DNA, 562 bp, Homo sapiens
  Payload ID: 14680
  Gene Symbol: RPS15
  Gene Name: ribosomal protein S15
  ENST ID: ENST00000586686
  CDS Start-End: 192-530
caggcgcggaccaaagcgatctcttctgaggatccggcaagatggcagaagtagagcagaagaagaagcggaccttccgcaagttcacctaccgcggcgtggacctcgaccagctgctggacatgtcctaggtctccccaggccgggccgctcacaaaactgcctggtgcatcctccccagcgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 176676 - DNA, 473 bp, Homo sapiens
  Payload ID: 14680
  Gene Symbol: RPS15
  Gene Name: ribosomal protein S15
  ENST ID: ENST00000589656
  CDS Start-End: 22-447
ctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccagcccgagatgatcggccactacctgggcgagttctccatcacctacaagcccgtaaagcatggccggcccggcatcggggccacccactcctcccgcttcatccctctcaagtaatggctcagctaataaaggcgcacatg

SEQ ID NO: 176677 - DNA, 534 bp, Homo sapiens
  Payload ID: 14680
  Gene Symbol: RPS15
  Gene Name: ribosomal protein S15
  ENST ID: ENST00000233609
  CDS Start-End: 146-502
catgccggcagtctcgcgataactgcgcaggcgcggaccaaagcgatctcttctgaggatccggcaagatgaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 176678 - DNA, 873 bp, Homo sapiens
  Payload ID: 14680
  Gene Symbol: RPS15
  Gene Name: ribosomal protein S15
  ENST ID: ENST00000592623
  CDS Start-End: 485-841
cgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 176679 - DNA, 711 bp, Homo sapiens
  Payload ID: 14680
  Gene Symbol: RPS15
  Gene Name: ribosomal protein S15
  ENST ID: ENST00000591804
  CDS Start-End: 341-679
tcttctgaggatccggcaagatggcagaagtagagcagaagaagaagcggaccttccgcaagttcacctaccgcggcgtggacctcgaccagctgctggacatgtcctagttggtcttgaactcctgggctcaagcgaccctcccgcctcaacctcccgaagtgctgggatcacaggcgggagccactgcgccctacctgccttcccctgcgtttttagaggcctttggcccgagctgtacgctgcagcaccttgtctgaggctgtggtctccgggccgcttgttctctctgaatctctgcagtcacacggtggctcttgcatgtgagggcgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcca

SEQ ID NO: 176680 - DNA, 550 bp, Homo sapiens
  Payload ID: 14680
  Gene Symbol: RPS15
  Gene Name: ribosomal protein S15
  ENST ID: ENST00000591032
  CDS Start-End: 115-522
gcgatctcttctgaggatccggcaagatggcagaagtagagcagaagaagaagcggaccttccgcaagttcacctaccgcggcgtggacctcgaccagctgctggacatgtcctatgcgtagggtctccccaggccgggccgctcacaaaactgcctggtgcatcctccccagcgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgac

SEQ ID NO: 176681 - DNA, 436 bp, Homo sapiens
  Payload ID: 14680
  Gene Symbol: RPS15
  Gene Name: ribosomal protein S15
  ENST ID: ENST00000586656
  CDS Start-End: 232-436
ctcttctgaggatccggcaagatggcagaagtagagcagaagaagaagcggaccttccgcaagttcacctaccgcggcgtggacctcgaccagctgctggacatgtcctaaggcctttggcccgagctgtacgctgcagcaccttgtctgaggctgtggtctccgggccgcttgttctctctgaatctctgcagtcacacggtggctcttgcatgtgagggcgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagacct

SEQ ID NO: 176682 - DNA, 338 bp, Homo sapiens
  Payload ID: 14680
  Gene Symbol: RPS15
  Gene Name: ribosomal protein S15
  ENST ID: ENST00000617694
  CDS Start-End: 318-338
caagatggcagaagtagagcagaagaagaagcggaccttccgcaagttcacctaccgcggcgtggacctcgaccagctgctggacatgtcctagttggtcttgaactcctgggctcaagcgaccctcccgcctcaacctcccgaagtgctgggatcacaggcgggagccactgcgccctacctgccttcccctgcgtttttagaggcctttggcccgagctgtacgctgcagcaccttgtctgaggctgtggtctccgggccgcttgttctctctgaatctctgcagtcacacggtggctcttgcatgtgagggctgatgcagctgtacagtgcgcgc

SEQ ID NO: 176683 - DNA, 2203 bp, Homo sapiens
  Payload ID: 14681
  Gene Symbol: RPS15A
  Gene Name: ribosomal protein S15a
  Uniprot ID: P62244
  ENST ID: ENST00000322989
  CDS Start-End: 97-489
ctctttccgccatctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaagtgactaatacagccaagggaaaaagttcttatgaaaccagtatgcctaagaaacagtcacccctgctgtctgccaaaaccaggtatttgacactaaatattttagttgtatttcagtttttttttttttttttcttttttggagacagagtctgactctattgctcaggctggagtgcagtggcgcgatcttggcccactgcaacctccacctcccgggttcaagtgattgtcctgtctcagccgcctgagtaactgggattacaagtgtgtgtcgccacatccggctaatttttatattttagtagagacagggtttcgccatgttgcccaggctggtcttgagttctgggcctcaagtgatcagcctacctcggcctcccgaagtgctgggattacagccacgagccattacacctggcctatatttcagtattttctattagtttttgatgaatttgttttgcctggctaggattattctgtagataggattttagatctggcttttgtcactgactgctgtaataaatacttgctaggaatttttttttttttttttttttttttaagacaaagtcgctctgtcacacaggctggagtgcagtggcatgatcttggctcactgcacctccgcttcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatatgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcagcatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggtgtgtagggatgcctcagtcgcttacatgttgattgagtgaatcgtcggtttctttctggacactgacttcaaaaataaaataggatatgaaaatgg

SEQ ID NO: 176684 - DNA, 525 bp, Homo sapiens
  Payload ID: 14681
  Gene Symbol: RPS15A
  Gene Name: ribosomal protein S15a
  Uniprot ID: P62244
  ENST ID: ENST00000563390
  CDS Start-End: 80-472
gcgatagctctcccgcttcccataactccgtgcgctctcccctcccgtcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttcc

SEQ ID NO: 176685 - DNA, 427 bp, Homo sapiens
  Payload ID: 14681
  Gene Symbol: RPS15A
  Gene Name: ribosomal protein S15a
  ENST ID: ENST00000562935
  CDS Start-End: 31-183
ctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatgagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 176686 - DNA, 481 bp, Homo sapiens
  Payload ID: 14681
  Gene Symbol: RPS15A
  Gene Name: ribosomal protein S15a
  ENST ID: ENST00000569365
  CDS Start-End: 31-180
ctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatgtcagttatcttttgtaggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 176687 - DNA, 284 bp, Homo sapiens
  Payload ID: 14681
  Gene Symbol: RPS15A
  Gene Name: ribosomal protein S15a
  ENST ID: ENST00000563579
  CDS Start-End: 1-176
agtgtggggtgatcagccccagatttgacgtgcaactcaaagacctggaaaaatggcagaataatctgcttccatcccgccagtttggaatttataccctccaaattatgcgtctggtgccttggttgaaagtattctcacttcatggttgctgtattacagtttcattgtactgacaacctcagctggcatcatggaccatgaagaagcaagacgaaaacacacaggagggaaaatcctgggattctttttctagggatgtaatacatatatttacaaataaa

SEQ ID NO: 176688 - DNA, 802 bp, Homo sapiens
  Payload ID: 14681
  Gene Symbol: RPS15A
  Gene Name: ribosomal protein S15a
  Uniprot ID: P62244
  ENST ID: ENST00000565420
  CDS Start-End: 370-762
ccatcctgcaatctaaggttcggtctcggtgtcctgcgaggaggctggtccccaccttggccgaggatcctggccttgccggttcctggacaggcatagaggagagccatggctgggcgccccagactgtgcactcaggggatcccggtccgtggggtgcaggccgcagcgcgggcgggagccggagccttcgactgcccagctaggcggtagctccggttcgggccgcagcgtctggatctccctttagtgctgaggcagcgccttggccccgggcggcgggcaacatcggggctggtgggccgtgcagcttctcactgctgcggccgcgctgggagcttgggaggctgaggccacccagcagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatgga

SEQ ID NO: 176689 - DNA, 797 bp, Homo sapiens
  Payload ID: 14681
  Gene Symbol: RPS15A
  Gene Name: ribosomal protein S15a
  Uniprot ID: P62244
  ENST ID: ENST00000572008
  CDS Start-End: 31-423
ctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaaattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctg

SEQ ID NO: 176690 - DNA, 589 bp, Homo sapiens
  Payload ID: 14681
  Gene Symbol: RPS15A
  Gene Name: ribosomal protein S15a
  ENST ID: ENST00000576008
  CDS Start-End: 59-394
ataactccgtgcgctctcccctcccgtcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaaggttggagtgcagtggcacgatcttggctactgcaacctctgtctcccaggttcaagcgattctcctgcctcagcctccctagtagctgagattacagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 176691 - DNA, 2190 bp, Homo sapiens
  Payload ID: 14681
  Gene Symbol: RPS15A
  Gene Name: ribosomal protein S15a
  ENST ID: ENST00000576436
  CDS Start-End: 25-360
ttttgtcttccttgaacagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaaggttggagtgcagtggcacgatcttggctactgcaacctctgtctcccaggttcaagcgattctcctgcctcagcctccctagtagctgagattacagtgtggggtgatcagccccagatttgacgtgcaactcaaagacctggaaaaatggcagaataatctgcttccatcccgccagtttgggtaagttggcctttccttaattaaaagaagttaatgctaagaatttctgtggtgcagtttgacttaagggtttttttctttttttctgtttaaaacaaagcagtggtaatttgtctactcttaaccattttgacctaatagctcaagtgttatccatatttcttttctctctctttaaaaagagacagggttggccaggcacagtggctcacgcctgtgatcctagcattttgggaggctgaggcaggcggatcacctgaggttgggagttcgagaccaccctgaccaacatggagaaccccgtgtctacctaaaatacaaaattagccaggcctggtggcacacacctgtgatcccagctacttgagaggctgaggcaggaaaatagcttgaacccgggagagaggttgcggtgagctgagattgtgccattgcactccagcctgggcaacgagtgaaactctgtctcgagaaaaaagagagagagacagggtttcactttgttgcccaggctggagtgcagtggctgttcacaggtgcggtcataacacgctacagccttggcttcttggcctcgagcagtcctccccgctcagcctcttgtggatttgggaatacaggcgcctgccaccgtgcctggctatttgccacatttcatgtgttgagcttcaggttctgagaggcacatgagagcttagactggcagaaaaggggggtcgtgtccactttcatgtctgcccttttggctcactgcagatagttccctgtgatcccagatgagggccagaatcagttctaagcctaggcctttgggaaaacttagtttgggagtctttgtccttaaaagcctatctgagttcaaacccttgtttttctgctttaaagccatgagatcttgggcaagtcacagccttgatttcttcatccgtaaaagtggtaatagttcctctgtttatcacctgatttaattttggtaaagcactttatgagctgacacagtaaatgtgtatctttgtggttaagaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggtgtaggcagaagtcagggctgtgtgattgtgtggctgggctctctggatttggctctttgggttgcaggagtcatggctcatacgctacatgaggcaccagctcatgtaggcactgtcagttcctatgtgccccacaggaaagcgcccttaaccactgatgagtgttgatgtttttctgcactagaaggcactatgttgaactattaaacttaccagcactttctttttccactccatagtttcattgtactgacaacctcagctggcatcatggaccatgaagaagcaagacgaaaacacacaggagggaaaatcctgggattctttttctagggatgtaatacatatatttacaaataaaatgcctcatggac

SEQ ID NO: 176692 - DNA, 418 bp, Homo sapiens
  Payload ID: 14681
  Gene Symbol: RPS15A
  Gene Name: ribosomal protein S15a
  ENST ID: ENST00000574723
  CDS Start-End: 59-217
ataactccgtgcgctctcccctcccgtcctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatgtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggt

SEQ ID NO: 176693 - DNA, 1022 bp, Homo sapiens
  Payload ID: 14681
  Gene Symbol: RPS15A
  Gene Name: ribosomal protein S15a
  ENST ID: ENST00000569083
  CDS Start-End: 7-309
gccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttgggtaagttggcctttccttaattaaaagaagttaatgctaagaatttctgtggtgcagtttgacttaagggtttttttctttttttctgtttaaaacaaagcagtggtaatttgtctactcttaaccattttgacctaatagctcaagtgttatccatatttcttttctctctctttaaaaagagacagggttggccaggcacagtggctcacgcctgtgatcctagcattttgggaggctgaggcaggcggatcacctgaggttgggagttcgagaccaccctgaccaacatggagaaccccgtgtctacctaaaatacaaaattagccaggcctggtggcacacacctgtgatcccagctacttgagaggctgaggcaggaaaatagcttgaacccgggagagaggttgcggtgagctgagattgtgccattgcactccagcctgggcaacgagtgaaactctgtctcgagaaaaaagagagagagacagggtttcactttgttgcccaggctggagtgcagtggctgttcacaggtgcggtcataacacgctacagccttggcttcttggcctcgagcagtcctccccgctcagcctcttgtggatttgggaatacaggcgcctgccaccgtgcctggctatttgccacatttcatgtgttgagcttcaggttctgagaggcacatgagagcttagactggcagaaaaggggggt

SEQ ID NO: 176694 - DNA, 560 bp, Homo sapiens
  Payload ID: 14682
  Gene Symbol: RPS16
  Gene Name: ribosomal protein S16
  Uniprot ID: P62249
  ENST ID: ENST00000251453
  CDS Start-End: 54-494
cttttccggttgcggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaagaa

SEQ ID NO: 176695 - DNA, 643 bp, Homo sapiens
  Payload ID: 14682
  Gene Symbol: RPS16
  Gene Name: ribosomal protein S16
  ENST ID: ENST00000339471
  CDS Start-End: 42-500
cggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaagaa

SEQ ID NO: 176696 - DNA, 444 bp, Homo sapiens
  Payload ID: 14682
  Gene Symbol: RPS16
  Gene Name: ribosomal protein S16
  ENST ID: ENST00000602153
  CDS Start-End: 1-153
ctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatgtgagtgagcatgggtccttcccatgaggtagatgggtgtgtggggatcaagtcaaggactctgtgtgattatctaaatcctcgtccctgctcttcttgccagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggat

SEQ ID NO: 176697 - DNA, 407 bp, Homo sapiens
  Payload ID: 14682
  Gene Symbol: RPS16
  Gene Name: ribosomal protein S16
  ENST ID: ENST00000599705
  CDS Start-End: 1-258
acagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatgtgaatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgact

SEQ ID NO: 176698 - DNA, 492 bp, Homo sapiens
  Payload ID: 14682
  Gene Symbol: RPS16
  Gene Name: ribosomal protein S16
  ENST ID: ENST00000601655
  CDS Start-End: 47-436
ggttgcggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaa

SEQ ID NO: 176699 - DNA, 555 bp, Homo sapiens
  Payload ID: 14682
  Gene Symbol: RPS16
  Gene Name: ribosomal protein S16
  ENST ID: ENST00000599539
  CDS Start-End: 21-323
tctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatgtgagtgagcatgggtccttcccatgagatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaagaa

SEQ ID NO: 176700 - DNA, 592 bp, Homo sapiens
  Payload ID: 14683
  Gene Symbol: RPS17
  Gene Name: ribosomal protein S17
  Uniprot ID: P08708
  ENST ID: ENST00000330244
  CDS Start-End: 137-544
actccgccagggggcgctgtgtggctcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagc

SEQ ID NO: 176701 - DNA, 583 bp, Homo sapiens
  Payload ID: 14683
  Gene Symbol: RPS17
  Gene Name: ribosomal protein S17
  ENST ID: ENST00000558397
  CDS Start-End: 10-583
cccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttgctggcttacgttgccccctttgtgtcagccctggctgaatctgcctgcttttcttctgtgaaggcattcctttggtgtctccatgctaaccactcagaaatgagctttggtccatttccaggacttcggcagtctgtccaaccttcaggtcactcagcctacagttgggatgaatttcaaaacgcctcggggacctgtttgaattttttctgtagtgctgtattattttcaataaatctgggacaac

SEQ ID NO: 176702 - DNA, 522 bp, Homo sapiens
  Payload ID: 14683
  Gene Symbol: RPS17
  Gene Name: ribosomal protein S17
  ENST ID: ENST00000561068
  CDS Start-End: 1-179
gccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttgcagttactgttcgagagatttataggcatatggcctggaagaatagtgccaaagtcaacgtattaattgccaattatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggac

SEQ ID NO: 176703 - DNA, 1909 bp, Homo sapiens
  Payload ID: 14683
  Gene Symbol: RPS17
  Gene Name: ribosomal protein S17
  ENST ID: ENST00000561157
  CDS Start-End: 32-442
ctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggtaagtgtttgctggattcctaaagtggtattttcctggtcaaaaaccatcagtaggtcttattatccaaggtcacccagctagtaagtggcagagttgggaatcccatctaaacttgtagccactaaactggactgctttcataaggggtgtagcggaagttgtgtgcattgagttagttcgccacaagatcatgattcccaaatctagtggcttccaggacaccttttctctcttggctgcttctgttcttggttttatagctggcttacgttgccccctttgtgtcagccctggctgaatctgcctgcttttcttctgtgaaggcattcctttggtgtctccatgctaaccactcagaaatgagctttggtccatttccaggtacatacaaggcactacttaggtagttcacgagtatcttcattgcactttgatgttttttctatggcttatcttagtccttttgcatacttgggtgaaagcatgggcttcatgggcggttggtgattttgaacaacttcatttttcctatttttatggtcattaaatgtttaagacactcaaaaaggtagtagcaaaatgaactcacatgtactttcccagcttcagaaaaacatcaccagtacagctacagccccgctgtgggtcttttcttcctgaaataaccactgcgctgaatgcagcatttttgttgaaactaaaatgggtttctgaggaccaaataggacatggagttccaggtataagttgggcccttggcttcttgccctgcctaccagcctgaacttgtttgagggcagggtctgctcttgcctccctcccttctgcttgatgccttgtgtacttgggcccttcacaaatgttgattagattagtaatagctcttacccagggctggtcctggaaagcaagtggcactgtgtattctcaaagggacagagttttgctttagaggacatttggcaatgtccagacacatttttcgttctcatagccaggggatacctgctaacttctaaggggtagaggccaaggatgttgctaaactttctgcaatacacagtacagctgcctataacaaagaatgtccagcccaggatgtctacgttgccaagattgagaaacggtgttttagagtgattgataggaaggggttgtgaaaacagatacaaatggcatggtacattgggtaaaagtcatagagttgtaaatggggataccacatggtcaggtgtgtgttgaaggaagatcactctggaaaagtgggaggcattgagaaccctgttggctcttaaagggtccttcaggtcgcctctggacccccttgagagtgctgtggctctaggggcctgtgttttcttctggggtccactcacagatctcaccagtaactgctcactgaatccattttctcgttccaggacttcggcagtctgtccaaccttcaggtcactcagcctacagttgggatgaatttcaaaacgcctcggggacctgtttgaattttttctgtagtgctgtattattttcaataaatctgggacaaca

SEQ ID NO: 176704 - DNA, 592 bp, Homo sapiens; identical to SEQ ID NO: 176700
  Payload ID: 14683
  Gene Symbol: RPS17
  Gene Name: ribosomal protein S17
  Uniprot ID: P08708
  ENST ID: ENST00000617731
  CDS Start-End: 137-544

SEQ ID NO: 176705 - DNA, 522 bp, Homo sapiens; identical to SEQ ID NO: 176702
  Payload ID: 14683
  Gene Symbol: RPS17
  Gene Name: ribosomal protein S17
  ENST ID: ENST00000632799
  CDS Start-End: 1-179

SEQ ID NO: 176706 - DNA, 1909 bp, Homo sapiens; identical to SEQ ID NO: 176703
  Payload ID: 14683
  Gene Symbol: RPS17
  Gene Name: ribosomal protein S17
  ENST ID: ENST00000632419
  CDS Start-End: 32-442

SEQ ID NO: 176707 - DNA, 613 bp, Homo sapiens
  Payload ID: 14684
  Gene Symbol: RPS18
  Gene Name: ribosomal protein S18
  Uniprot ID: P62269
  ENST ID: ENST00000211372
  CDS Start-End: 111-569
cttctcctagatcgcaccgcctcttcctcctggaagctatataatgatatcgcgtcacttccgctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 176708 - DNA, 212 bp, Homo sapiens
  Payload ID: 14684
  Gene Symbol: RPS18
  Gene Name: ribosomal protein S18
  ENST ID: ENST00000440980
  CDS Start-End: 111-212
cttctcctagatcgcaccgcctcttcctcctggaagctatataatgatatcgcgtcacttccgctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaag

SEQ ID NO: 176709 - DNA, 613 bp, Homo sapiens; identical to SEQ ID NO: 176707
  Payload ID: 14684
  Gene Symbol: RPS18
  Gene Name: ribosomal protein S18
  Uniprot ID: P62269
  ENST ID: ENST00000439602
  CDS Start-End: 111-569

SEQ ID NO: 176710 - DNA, 613 bp, Homo sapiens; identical to SEQ ID NO: 176707
  Payload ID: 14684
  Gene Symbol: RPS18
  Gene Name: ribosomal protein S18
  Uniprot ID: P62269
  ENST ID: ENST00000434122
  CDS Start-End: 111-569

SEQ ID NO: 176711 - DNA, 613 bp, Homo sapiens; identical to SEQ ID NO: 176707
  Payload ID: 14684
  Gene Symbol: RPS18
  Gene Name: ribosomal protein S18
  Uniprot ID: P62269
  ENST ID: ENST00000457341
  CDS Start-End: 111-569

SEQ ID NO: 176712 - DNA, 613 bp, Homo sapiens; identical to SEQ ID NO: 176707
  Payload ID: 14684
  Gene Symbol: RPS18
  Gene Name: ribosomal protein S18
  Uniprot ID: P62269
  ENST ID: ENST00000454021
  CDS Start-End: 111-569

SEQ ID NO: 176713 - DNA, 685 bp, Homo sapiens
  Payload ID: 14684
  Gene Symbol: RPS18
  Gene Name: ribosomal protein S18
  ENST ID: ENST00000484321
  CDS Start-End: 393-641
cacgccgccgcttgtgctgcagccatgtctctagtgatccctgaaaagttccagcatattttgcgagtactcaacaccaacatcgatgggcggcggaaaatagcctttgccatcactgccattaagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 176714 - DNA, 685 bp, Homo sapiens; identical to SEQ ID NO: 176713
  Payload ID: 14684
  Gene Symbol: RPS18
  Gene Name: ribosomal protein S18
  ENST ID: ENST00000476288
  CDS Start-End: 393-641

SEQ ID NO: 176715 - DNA, 685 bp, Homo sapiens; identical to SEQ ID NO: 176713
  Payload ID: 14684
  Gene Symbol: RPS18
  Gene Name: ribosomal protein S18
  ENST ID: ENST00000494232
  CDS Start-End: 393-641

SEQ ID NO: 176716 - DNA, 589 bp, Homo sapiens
  Payload ID: 14684
  Gene Symbol: RPS18
  Gene Name: ribosomal protein S18
  ENST ID: ENST00000486781
  CDS Start-End: 297-545
ctctcttccacaggaggcctacacgccgccgcttgtgctgcagccatgtttactgtgtctgatttcttcccccgtactttttcaactagtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 176717 - DNA, 589 bp, Homo sapiens; identical to SEQ ID NO: 176716
  Payload ID: 14684
  Gene Symbol: RPS18
  Gene Name: ribosomal protein S18
  ENST ID: ENST00000474973
  CDS Start-End: 297-545

SEQ ID NO: 176718 - DNA, 654 bp, Homo sapiens
  Payload ID: 14684
  Gene Symbol: RPS18
  Gene Name: ribosomal protein S18
  ENST ID: ENST00000477055
  CDS Start-End: 362-610
cttctcctagatcgcaccgcctcttcctcctggaagctatataatgatatcgcgtcacttccgctctctcttccacaggaggcctacacgccgccgcttgtgctgcagccatgtttactgtgtctgatttcttcccccgtactttttcaactagtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 176719 - DNA, 99 bp, Homo sapiens
  Payload ID: 14684
  Gene Symbol: RPS18
  Gene Name: ribosomal protein S18
  ENST ID: ENST00000630000
  CDS Start-End: 1-99
tctctagtgatccctgaaaagttccagcatattttgcgagtactcaacaccaacatcgatgggcggcggaaaatagcctttgccatcactgccattaag

SEQ ID NO: 176720 - DNA, 500 bp, Homo sapiens
  Payload ID: 14685
  Gene Symbol: RPS19
  Gene Name: ribosomal protein S19
  ENST ID: ENST00000221975
  CDS Start-End: 246-461
ctttcccctggctggcagcgcggaggccgcacgttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaacaaaccatgctgggttaataaattgcctcattcgtaa

SEQ ID NO: 176721 - DNA, 420 bp, Homo sapiens
  Payload ID: 14685
  Gene Symbol: RPS19
  Gene Name: ribosomal protein S19
  ENST ID: ENST00000600467
  CDS Start-End: 192-420
ccctttcccctggctggcagcgcggaggccgcacggtaagcgggggctccgagctggaccgggcgcgaggcggcagggccggacgccgaagcctcagagcgcgtgcctgagggccccgaggcgcccggcgcgggcccgtcccgccccctagagccgcggccacgtgcgagcggcaggcccggacatgcccgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgacca

SEQ ID NO: 176722 - DNA, 307 bp, Homo sapiens
  Payload ID: 14685
  Gene Symbol: RPS19
  Gene Name: ribosomal protein S19
  ENST ID: ENST00000598261
  CDS Start-End: 7-307
cctcagatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctggtgaggaacttagcttccacagcgcggcacctgtacctccggggtggcgctggggttggctccatgaccaagatctatgggggacgtcagagaaacggcgtcatgcccagccacttcagccgaggctcc

SEQ ID NO: 176723 - DNA, 526 bp, Homo sapiens
  Payload ID: 14685
  Gene Symbol: RPS19
  Gene Name: ribosomal protein S19
  Uniprot ID: P39019
  ENST ID: ENST00000593863
  CDS Start-End: 50-487
gtcagcgccgtccgggaaccgagcgtgggccccggggggcagcggcgggatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaacaaaccatgctgggttaataaattgcctcattcgtaa

SEQ ID NO: 176724 - DNA, 2359 bp, Homo sapiens
  Payload ID: 14685
  Gene Symbol: RPS19
  Gene Name: ribosomal protein S19
  Uniprot ID: P39019
  ENST ID: ENST00000598742
  CDS Start-End: 373-810
gtactttcgccatcatagtattctccaccactgttccttccagccacgaacgacgcaaacgaagccaagttcccccagctccgaacaggagctctctatcctctctctattacactccgggagaaggaaacgcgggaggaaacccaggcctccacgcgcgaccccttggccctcccctttacctctccacccctcactagacaccctcccctctaggcggggacgaactttcgccctgagagaggcggagcctcagcgtctaccctcgctctcgcgagctttcggaactctcgcgagaccctacgcccgacttgtgcgcccgggaaaccccgtcgttccctttcccctggctggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaacaaaccatgctgggttaataaattgcctcattcgtaatcctggtctgggtctcttttttgagtctcttgctctgtcgcccaggctggagtgcagtggcgccatctcagctcactgcaatctccgccttctgggttcaaatgattctcctgcctcagcctcccaaagtgctgggattacaagtgtgagccactgtgcctggtctggtttgggtctcttgattgttcttcaggggcatgaggaagaggcgcttcctcccttcccttgggtgagggggcccagggtgattgggtggctgtttacccggcagccagtcgggccttcccaggtcaaacagttcccatctgggtttggaggaaggacccaggggcccttgtggctcactcccccacatcctgtctttgcaattgtcagaaagtgagaaacgaaaggatggctgtgagctgtgacctcagctgggcctgggctgcagaggtggcttccgctggagtaaagcaagagggcccagggttcatgctcttccctggaaggtagaaaaggacagaccaccagggagcctccaccgcaaactgacctgtgctgcctacacactaactttcctgggcctggggcctgcacaggctgaatggtccttgagccttcactctgcatctgagcggtcttgggcccgctgagtggcagtggcaggaagtcggtggaagcagatccctgtgcagaagttgaattaccagggcggccacacacgggctgcacaacctttgcagtcgtgcacggcaagtgggatgtggcctccgcccatgattgggcacctggtcaggctgggagatccaaatagcacccagtgggcagctgtccgacccctggaggggcaagccaggaaagaaacttagggcccgctgtgaccagatgtccctcccagttgggaagactaaactggtttggccaatatctcccaggattcccctgtccaaattattcctgggatctgacccatttcctggaaaggggcgagcctgggttttgaagttcaaactagagtttaaatcacaactctgcccctaatcccacgtaaccctgtgcaccttatcctctgagccttcgtctcctcgtgtgtaagcctgctaactcctgagagactggacaagatgccgtggagagccttggctctgagtagctctgctgctggacagttcagttggcagtccccaaacgtaaggcgtaagagtttaagaagtatcggccaggcacagtggctcacacctgtaatctcaacactttgggaggccgagacgggctgatcacctgaggttgggagcttgagaacagcctgaccaacatggagaaaccctgtctctaaaaataccaaaattagttgggcatggtggcgcgcacctgtaatcccagctactcaggaggctgaggcagaagaatcgctcgaaccccggaggcggaggttgcagtgggttgagatcgagcaattgcaatccagcctgggcaacagagcgagactccatttcaaaaaaagaatcaataaaaatgttaaaagcac

SEQ ID NO: 176725 - DNA, 342 bp, Homo sapiens
  Payload ID: 14685
  Gene Symbol: RPS19
  Gene Name: ribosomal protein S19
  ENST ID: ENST00000601492
  CDS Start-End: 36-342
ccctttcccctggctggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctggtggtttaatcctttctatatacacggaggcagactccctgggtttggatccatcttttacatctggctgtgtgtcctctgcttccacagcgcggcacctgtacctccggggtggcgctggggttggctccatga

SEQ ID NO: 176726 - DNA, 1172 bp, Homo sapiens
  Payload ID: 14685
  Gene Symbol: RPS19
  Gene Name: ribosomal protein S19
  ENST ID: ENST00000598399
  CDS Start-End: 1-216
cctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgagttgcactgtcaccaggctggagtacactggtgccgtctcggctaactgcaacctctgcctgccgggttcaagcaattctcctacctcagcctcccaagtacctgggactacaggacctgctgaagatggagatgtgggagtccagtttggtgtcctggtgtgcgtctgagagcagctgctgaattgggatgtctggaaacacttcttgtaggttggaggctgctccatctctggctcctgcatggggctgggcacccacttgtgctatgatagtagaaagaatgagatctgggaggcatcacagaagtgagttaagggatgaatcaaggtcaggagagtggtttcttacaagttcggcagagaagggtcagctagagtgtgctggggaagttcttccctgcctttgactcagtaggtcaggatgggaccaccggtctggactttgctgagctgtgatgactcctaaggagccgtgcttggttggtctgccccgtgctcagatccagagggaccctccctctcggtctagcaggaacacagctgccctcccttgaccatgaactcacagtagagtggagaggggtggcctcctttacagttccaggtagggggtgattcctggacaggggttcctgagaggagtgggttgccatcccaagaatgcacacagcagaggagcagaaggcctctagcatggaggaactggaggagaacccatttgtgacagcaacttgctcgcaattggccctcatgagtaccagctacggcggtctgcatttgtgcagctccacatcaaaagctggggctggaaccttggtctccagggggtgaggaaaaagcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaa

SEQ ID NO: 176727 - DNA, 927 bp, Homo sapiens
  Payload ID: 14686
  Gene Symbol: RPS19BP1
  Gene Name: ribosomal protein S19 binding protein 1
  Uniprot ID: Q86WX3
  ENST ID: ENST00000334678
  CDS Start-End: 118-528
ggcacttccgcccatccccctccggatccctctgttcgggctcgggtttccgccgagacgacagggactgccaggtcggaagtagtgtgaggctcgtgggcggagccaagcgccgccatgtccgccgccctgctgcggcggggcctggagctgctggcggcgtccgaggccccccgggaccctccaggtcaggccaagccgagaggggctccggtgaaacggccccggaagacgaaggcaattcaggcccagaaactgcggaactcggccaagggaaaggtgcccaagtcggcactggacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagcccttggggacgacagctccaggagtaggaagaagggtgggcttccaagttacaataaatgtgaacccaaga

SEQ ID NO: 176728 - DNA, 861 bp, Homo sapiens
  Payload ID: 14686
  Gene Symbol: RPS19BP1
  Gene Name: ribosomal protein S19 binding protein 1
  ENST ID: ENST00000420879
  CDS Start-End: 24-233
cgtgggcggagccaagcgccgccatgtccgccgccctgctgcggcggggcctggagctgctggcggcgtccgaggccccccgggaccctccaggtcaggccaagccgagaggggctccggtgaaacggccccggaagacgaaggcaattcaggcccagaaactgcggaactcggccaagggaaaggtgcccaagtcggcactggacggggtttcaccatgttggccacgctgatctcgaactcctgacctcaggtgacctgcctgcctcggcctcccaaagtgctgagattacagacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagcccttgggg

SEQ ID NO: 176729 - DNA, 985 bp, Homo sapiens
  Payload ID: 14687
  Gene Symbol: RPS2
  Gene Name: ribosomal protein S2
  Uniprot ID: P15880
  ENST ID: ENST00000343262
  CDS Start-End: 58-939
gtgctataaaagctgcttcccagtaggtctcgttcttcttttccgacaaaacaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgttactgttt

SEQ ID NO: 176730 - DNA, 719 bp, Homo sapiens
  Payload ID: 14687
  Gene Symbol: RPS2
  Gene Name: ribosomal protein S2
  ENST ID: ENST00000527302
  CDS Start-End: 66-719
gtgagtcctgttggtcgctgcagcgggcctctgcgtgggcggcgggaatccgcggacatcggcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggt

SEQ ID NO: 176731 - DNA, 993 bp, Homo sapiens
  Payload ID: 14687
  Gene Symbol: RPS2
  Gene Name: ribosomal protein S2
  ENST ID: ENST00000529806
  CDS Start-End: 188-817
aaacacgtgagtcctgttggtcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaa

SEQ ID NO: 176732 - DNA, 931 bp, Homo sapiens
  Payload ID: 14687
  Gene Symbol: RPS2
  Gene Name: ribosomal protein S2
  ENST ID: ENST00000532746
  CDS Start-End: 1-191
agtggatgcccgtcaccaagttgggccgcttggtcaaggacatgaagatcaagtccctggaggagatctatctcttctccctgcctattaagcaaggtacggtggtcatggctaggccaaagctggacaaagcaaaaggaaatctgagtggaaagccacatctcaccaaacaagagaaaaagggcaaataggaagaaacgattgagatgcagaaatagggtaaccttacatacaagcttccaaaaacgaaacgaaggggacagatcggggggaagccaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtg

SEQ ID NO: 176733 - DNA, 625 bp, Homo sapiens
  Payload ID: 14687
  Gene Symbol: RPS2
  Gene Name: ribosomal protein S2
  ENST ID: ENST00000533186
  CDS Start-End: 1-588
gtcaccaagttgggccgcttggtcaaggacatgaagatcaagtccctggaggagatctatctcttctccctgcctattaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtg

SEQ ID NO: 176734 - DNA, 765 bp, Homo sapiens
  Payload ID: 14687
  Gene Symbol: RPS2
  Gene Name: ribosomal protein S2
  ENST ID: ENST00000530225
  CDS Start-End: 7-600
cagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaagccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtg

SEQ ID NO: 176735 - DNA, 924 bp, Homo sapiens
  Payload ID: 14687
  Gene Symbol: RPS2
  Gene Name: ribosomal protein S2
  ENST ID: ENST00000526522
  CDS Start-End: 179-886
agtcctgttggtcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgt

SEQ ID NO: 176736 - DNA, 170 bp, Homo sapiens
  Payload ID: 14687
  Gene Symbol: RPS2
  Gene Name: ribosomal protein S2
  ENST ID: ENST00000563194
  CDS Start-End: 39-170
ccagtaggtctcgttcttcttttccgacaaaacactggatgcccgtcaccaagttgggccgcttggtcaaggacatgaagatcaagtccctggaggagatctatctcttctccctgcctattaaggaatcagagatcattgatttcttcctgggggcctctctcaaggat

SEQ ID NO: 176737 - DNA, 878 bp, Homo sapiens
  Payload ID: 14687
  Gene Symbol: RPS2
  Gene Name: ribosomal protein S2
  ENST ID: ENST00000526586
  CDS Start-End: 1-468
gaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcggtaggtggtccacacatggggcatagccatggtctctcagctccgcttaaccacacgggtccagtgtgtgcttggcgtgttttcagggaggcagagaaaggctctcctaatgcacgacagacccgcccagaatggcctctctgttcctaggagtgcgacaatttttgggttgggggacttgcctcaagcacaccactgaccctcctggggttcttttgttttgcagccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtg

SEQ ID NO: 176738 - DNA, 626 bp, Homo sapiens
  Payload ID: 14688
  Gene Symbol: RPS20
  Gene Name: ribosomal protein S20
  Uniprot ID: P60866
  ENST ID: ENST00000009589
  CDS Start-End: 124-483
ctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacttctgttggtttttattcagaatactggcagattttaggaatataaaggtgtactatgagacttccacttttcaggtggaatatatgggtatcttagagtggtcta

SEQ ID NO: 176739 - DNA, 650 bp, Homo sapiens
  Payload ID: 14688
  Gene Symbol: RPS20
  Gene Name: ribosomal protein S20
  Uniprot ID: P60866
  ENST ID: ENST00000521262
  CDS Start-End: 255-614
ctttctttttgaggaagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 176740 - DNA, 423 bp, Homo sapiens
  Payload ID: 14688
  Gene Symbol: RPS20
  Gene Name: ribosomal protein S20
  ENST ID: ENST00000520627
  CDS Start-End: 193-387
ctttctttttgaggaagacgcggtcgtaagggctgaggatttttggtccgcacgctcctgctcctgactcaccgctgttcgctctcgccgaggaacaagtcggtcaggaagcccgcgcgcaacagccatgtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 176741 - DNA, 899 bp, Homo sapiens
  Payload ID: 14688
  Gene Symbol: RPS20
  Gene Name: ribosomal protein S20
  ENST ID: ENST00000523936
  CDS Start-End: 101-286
ggcgcaacgcagggctcgggcgccggggggaccccggtttcgagttcgtgctcctgagggcagatgccggggcgtgtaggggcggaaaggcgctcctgaaatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaaggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataagtataaaacgataaacacttggtttcctttgtcttttgttacagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataa

SEQ ID NO: 176742 - DNA, 671 bp, Homo sapiens
  Payload ID: 14688
  Gene Symbol: RPS20
  Gene Name: ribosomal protein S20
  ENST ID: ENST00000518875
  CDS Start-End: 116-301
ggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaaggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataag

SEQ ID NO: 176743 - DNA, 752 bp, Homo sapiens
  Payload ID: 14688
  Gene Symbol: RPS20
  Gene Name: ribosomal protein S20
  ENST ID: ENST00000524349
  CDS Start-End: 510-704
ctttttgaggaagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggtggggaaacgcgggaagcttccggaagctgcctttctccagaagtggcagaccatttttggcttattgttctttttcatgtatctaataataggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacttctgttggtt

SEQ ID NO: 176744 - DNA, 424 bp, Homo sapiens
  Payload ID: 14688
  Gene Symbol: RPS20
  Gene Name: ribosomal protein S20
  ENST ID: ENST00000519606
  CDS Start-End: 124-264
ctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaat

SEQ ID NO: 176745 - DNA, 1826 bp, Homo sapiens
  Payload ID: 14688
  Gene Symbol: RPS20
  Gene Name: ribosomal protein S20
  Uniprot ID: P60866
  ENST ID: ENST00000519807
  CDS Start-End: 127-555
tttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgagttgatcgaatctacagatgcagaacccatggatacagagggccagcagtacactttgagaagtgtattcgaatccccggggacatgtcctttttaactgcattctcctccgccaaaaaagtgaccaagcagagtctttctctgtcacccaggctggagtgcaatggcgtgatctcagctcactgcaacctctgcctcctgggttcaagtgattctcgtgtctcagcctcctgagtagctgagactacaggtgtgcaccagtgttcccagctgatttttgtattttatgtagagatggggttatgccattttggccaggctagtctcgaactcctgagctcaggtgatacacacacctcagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctgaaagagactcttttctaacagttctgtagcattaattatactcatactgttgtgcaacaaatatccagaaatcttttgtcttgcgaaactgaacctcttacccattaaacactaactcccttttttttcaccctgaaccattggcaaccacaattttactttctttttctgtgagtttgattacttgatacttcatgtgagtggaatcatataatatttgtctttttgtgactgacattttatttagcttaatgtcttcaagtttgacccataccatatcatgtggcaggatttttccctttttttttttttcagacggagtctcgctctgtcgcccaggctggagtgcagtggcgcgatctcggctcactgcaagctccgcctcccgggttcatgccattctcctgcctcagcctcctgagtagctgggactacaggcgcccaccactaaacccggctaatttttttgtatttttagtagagacagagtttcaccatgttaatgaggatggtctccatctcctgacctcgtgattcgctcgtctcggcctcccaaagtgctgggattacaggcgtgagccaccgcgcccggccatgatttttcttcttttttaaggctgaataatatctcaatgtatgtatatataccactttttaaaaattcattcatctgttggacatttagattgttcccacctcttgg

SEQ ID NO: 176746 - DNA, 627 bp, Homo sapiens
  Payload ID: 14688
  Gene Symbol: RPS20
  Gene Name: ribosomal protein S20
  Uniprot ID: P60866
  ENST ID: ENST00000618656
  CDS Start-End: 199-627
atatttcctgttccggggcgtgtgggacccggatgcaagcgtgctatataagcgttgctcaagtcccacccctttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgagttgatcgaatctacagatgcagaacccatggatacagagggccagcagtacactttgagaagtgtattcgaatccccggggacatgtcctttttaa

SEQ ID NO: 176747 - DNA, 344 bp, Homo sapiens
  Payload ID: 14689
  Gene Symbol: RPS21
  Gene Name: ribosomal protein S21
  Uniprot ID: P63220
  ENST ID: ENST00000343986
  CDS Start-End: 40-291
cgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacct

SEQ ID NO: 176748 - DNA, 1002 bp, Homo sapiens
  Payload ID: 14689
  Gene Symbol: RPS21
  Gene Name: ribosomal protein S21
  ENST ID: ENST00000370562
  CDS Start-End: 43-243
cggcgccgcgcggtgactccccaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggtgagctgggagcccgggaggcgggaaggttgtgatatatgtgcgggaaaggcaggctgtcccattgtggaggagcccctggggtgaaggtacaggcagaggctggctttgaggattggtgtttcccaaacctgggggagtggtttgtgacccttcttctctttctaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcactaggaggtgcccccccgaccccgctccaccatagtcaggctgcaggctgccccgggagaggtggctccccttctgcgcctgtctccattcgctcagcgggggagagacgtgggctggtggcacagctgaccttctgccatctcaggcagccggagtggaaatattcttagtgtgcttttttttttttcttaagggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaaccta

SEQ ID NO: 176749 - DNA, 401 bp, Homo sapiens
  Payload ID: 14689
  Gene Symbol: RPS21
  Gene Name: ribosomal protein S21
  ENST ID: ENST00000370592
  CDS Start-End: 15-287
agcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcac

SEQ ID NO: 176750 - DNA, 418 bp, Homo sapiens
  Payload ID: 14689
  Gene Symbol: RPS21
  Gene Name: ribosomal protein S21
  ENST ID: ENST00000450116
  CDS Start-End: 22-267
caggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacct

SEQ ID NO: 176751 - DNA, 3437 bp, Homo sapiens
  Payload ID: 14690
  Gene Symbol: RPS23
  Gene Name: ribosomal protein S23
  Uniprot ID: P62266
  ENST ID: ENST00000296674
  CDS Start-End: 255-686
tcaaaagaaaaagggggaaaaaaaaccatgcaaattagatatctctgaatttcttgcaaattaaataagacgcagattctggctcaggaaagtgatgcaaacgcgtcgttttcaaaggagagaccccagcctcgggtcaggcgcggcgcagacagcggcgcggggtccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccacgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgggatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtatcttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtaggatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttg

SEQ ID NO: 176752 - DNA, 530 bp, Homo sapiens
  Payload ID: 14690
  Gene Symbol: RPS23
  Gene Name: ribosomal protein S23
  ENST ID: ENST00000511844
  CDS Start-End: 33-200
tctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtgtaagtccattgctcccgtcaagttttagtttattataggaattcgagacatgaacttacgaattcttgttttgaaagtaattgcaggtttttgtgtagtagtattcatttgggcattgtggggtaaaattgcaaagcgtttgttctatttaaaagttggtaaaattagtttttgggaattaggtagttaaggttttaatttaacgttggcctggaaggaattggagaagatactagcaatgatgaagtaaaggacacaaacacctttactgtgggagttgttataagtaaatggcacgtgtcagctattgaactttatcgacttgataaaact

SEQ ID NO: 176753 - DNA, 836 bp, Homo sapiens
  Payload ID: 14690
  Gene Symbol: RPS23
  Gene Name: ribosomal protein S23
  ENST ID: ENST00000507980
  CDS Start-End: 32-403
ctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggtgagtatttcaactctatcgtaccttctgttcttggggtggcctccctcacatttttatctgatgcaagggagtttcctcacatgaaagtatttttgtgatcgccaccaacaccagaaataaacttcttattttattccaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccacgaagatcatgttcattaccaccaccacccccccttattttttttatcctaaaccagcaaacgcaggacctgtaccaattttaggagacaataagacagggttgtttcaggattctctagagttaataacatttgtaacctggcacagtt

SEQ ID NO: 176754 - DNA, 1019 bp, Homo sapiens
  Payload ID: 14690
  Gene Symbol: RPS23
  Gene Name: ribosomal protein S23
  ENST ID: ENST00000510019
  CDS Start-End: 74-331
gcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaggaaagaccaagatcataaatattaatggtgaaaacactgtagtaataaattttcatatgccaaaaaatgtttgtatcttactgtcccctgttctcaccacgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgggatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtatcttctcatgaggttgtcagagaccttc

SEQ ID NO: 176755 - DNA, 443 bp, Homo sapiens
  Payload ID: 14690
  Gene Symbol: RPS23
  Gene Name: ribosomal protein S23
  ENST ID: ENST00000512493
  CDS Start-End: 29-433
tttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaagagttttcatggatacagtggcatggttgaaatgaagctgtgagccttctgct

SEQ ID NO: 176756 - DNA, 1058 bp, Homo sapiens
  Payload ID: 14690
  Gene Symbol: RPS23
  Gene Name: ribosomal protein S23
  ENST ID: ENST00000510210
  CDS Start-End: 19-423
gcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaagagttttcatggatacagtggcatggttgaaatgaagctgtgagccttctgctttaaatctgatgtaagaaactcctgttaacaaatagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcggg

SEQ ID NO: 176757 - DNA, 514 bp, Homo sapiens
  Payload ID: 14691
  Gene Symbol: RPS24
  Gene Name: ribosomal protein S24
  Uniprot ID: P62847
  ENST ID: ENST00000360830
  CDS Start-End: 20-412
ctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttca

SEQ ID NO: 176758 - DNA, 510 bp, Homo sapiens
  Payload ID: 14691
  Gene Symbol: RPS24
  Gene Name: ribosomal protein S24
  Uniprot ID: P62847
  ENST ID: ENST00000372360
  CDS Start-End: 38-439
cttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttca

SEQ ID NO: 176759 - DNA, 2814 bp, Homo sapiens
  Payload ID: 14691
  Gene Symbol: RPS24
  Gene Name: ribosomal protein S24
  Uniprot ID: P62847
  ENST ID: ENST00000440692
  CDS Start-End: 143-1012
aggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagatgagggaattggggcttggagtgcaagcattgggaagaatttcccaggaagagagatgcacagatgtgaagaactcgaaggcaagagaaagccggggggttgtgtggcaggtagaagtgccaggaccgtggagcgtgtggacatgtggcagattgcggaggggctgtggcaagtatttacaggtggccgttacctggaggaagactgaaaacagagaacagtgctgccaggcgtgccttttggagagggcactggtcagaaacggagccttcatgtcgcctgcctcacctgctcctgctggttctccccaccctgtggacggtgacttggtcctccacttgccagaagccttgtcagcaaccttgactctgtcaccccacatccaggccatcaacaagtcttttggccctttctttgaaatccaccaggaatccagctgcttctccccaccttcctgcctctctggtctgggccactaatgtcactgccatggccgccttgctgcatttctgaggatgcttcatctctccaccttcttctccactcagcagccagcagggcactgtggaaatcggagtcacatgagctggcacctctgttcagaaccctccagggctccacatctctctcacccaaatgccaaagacctccccacgcccccacaatcccccacgacctggccactggcctcccaccaccttccagctccagcggctcctaccacatttaaggctttccttcctagttttaatttttcctcgtcagcagttgattttattattttcttgtttattggtattttcccactagaaatgaagctgcgtgaagttagagatttttttttttggtctgtgttcctaattagctcattgctatacccctggcgcccagaacaatgccttggacacagtacgcagtagactaaataaatacttgttgaatgactgactgacggaatgacggctgtgtggggagtggattgggtcgtgaggcagaggctgcggtggaaactcaggcaggaggtgatggtggttcttggggctgcggaatgccaagtttagaagctcttcctctgctgtggcacatgaaccggtcactcgagaaggcttttagatttactttgcctaatcccctcttagtgcatgtggggaaactgaggtacacaaaaggaattccccaccaagttaggggcagaacctagcccccttgtctcccagatggatatcttcttttttttttgagacggagtcttgctctgttgcccaggctggagtgcagtggtaccatcttggctcactgcaacctctgcttcccaggttcaagcgattctcctgcctcagcctcctgagtgtctgcgattacaggtgcacacaaccacgcctggctaatttttgtatttttagtagagacggggtttcaccgtgttggtcagggtgacctcaaactcctgacctcatgatccacccagctcagcctcccaacgtgctgggattacaggcatgagccaccgtgcctggctggacatcttgttattaaagcttcttctctctttgtaggggagggggagatgcctctggtggagaagaccagtgtggcagtgactgtgtctgttagtgaacctggtggctggttgagggtctgtcgtggtgactgaggacacatacaaagtgcttttctcagtggtcaccttggtgttggtgaataagggtcagaagatggctcctgtcctagggcactgccagtcggtttggaagctgaaatgcctgcttagcagtttgaggaaacacagaccttggaggatcttctggttgcctcttcaagaattcattctattccccttctgctccccaaatttgcttttcttggggtgggtcttggttggcctaagccaagaaagtatggcatctactccttccatagcaatagctcaggaataggcagtgacccagacctgaaccaatcagtgcatggaattacccctggccaaagtggttgattgaggctgggtgcaagcagagttgtgagaaggctcccatttggtggttggagagatcgcacttgctccagaggtcataatgtgcagatctgaggcttggaactgctgcagacattttgctaccacaagtgaagccaccctgacgacacagttgacaatttggagcagggcagagctgagagaacagcagggaaacagccagagtcttgctcaagcctccctgaagtatctatacccctggactctagttatgggggctaataaatgttatatactgtttaaggt

SEQ ID NO: 176760 - DNA, 656 bp, Homo sapiens
  Payload ID: 14691
  Gene Symbol: RPS24
  Gene Name: ribosomal protein S24
  ENST ID: ENST00000435275
  CDS Start-End: 143-538
aggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagcagtgagctggagattggatcacagccgaaggagtaaaggtgctgcaatgatgttagctgtggccactgtggatttttcgcaagaacattaataaactaaaaacttcatgtgtctggttgtttg

SEQ ID NO: 176761 - DNA, 538 bp, Homo sapiens
  Payload ID: 14691
  Gene Symbol: RPS24
  Gene Name: ribosomal protein S24
  ENST ID: ENST00000613865
  CDS Start-End: 143-538
aggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagaaacgt

SEQ ID NO: 176762 - DNA, 508 bp, Homo sapiens
  Payload ID: 14692
  Gene Symbol: RPS25
  Gene Name: ribosomal protein S25
  ENST ID: ENST00000532567
  CDS Start-End: 47-166
atcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaaggtagaaataagacctctctgaaagagactagggaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaa

SEQ ID NO: 176763 - DNA, 835 bp, Homo sapiens
  Payload ID: 14692
  Gene Symbol: RPS25
  Gene Name: ribosomal protein S25
  Uniprot ID: P62851
  ENST ID: ENST00000527673
  CDS Start-End: 407-784
tcctcctcctcctcccgcgccccccgtgcagccacctgctgcacttgcgcactgggagcgacacgctcgggcataagtagtgccggaaagttagctgccgagacctggtggattgcttttcgtttatcagtgcaggaaaacagcgctatagtatgcgtcacaactagcgcagactccggcagtatttaggcggtgcggcttgggaactagaatccacttcctgtcttccgcctcaggctagagggcgagcgcttcgccgtgggacttcttctgcctggctccgccttttgccccggaagtactcacagcggacggtggtttttgggcccgtttctgagcagcgcttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaa

SEQ ID NO: 176764 - DNA, 711 bp, Homo sapiens
  Payload ID: 14692
  Gene Symbol: RPS25
  Gene Name: ribosomal protein S25
  ENST ID: ENST00000527791
  CDS Start-End: 395-514
tcccgcgccccccgtgcagccacctgctgcacttgcgcactgggagcgacacgctcgggcataagtagtgccggaaagttagctgccgagacctggtggattgcttttcgtttatcagtgcaggaaaacagcgctatagtatgcgtcacaactagcgcagactccggcagtatttaggcggtgcggcttgggaactagaatccacttcctgtcttccgcctcaggctagagggcgagcgcttcgccgtgggacttcttctgcctggctccgccttttgccccggaagtactcacagcggacggtggtttttgggcccgtttctgagcagcgcttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaa

SEQ ID NO: 176765 - DNA, 711 bp, Homo sapiens; identical to SEQ ID NO: 176764
  Payload ID: 14692
  Gene Symbol: RPS25
  Gene Name: ribosomal protein S25
  ENST ID: ENST00000630540
  CDS Start-End: 395-514

SEQ ID NO: 176766 - DNA, 835 bp, Homo sapiens; identical to SEQ ID NO: 176763
  Payload ID: 14692
  Gene Symbol: RPS25
  Gene Name: ribosomal protein S25
  Uniprot ID: P62851
  ENST ID: ENST00000628770
  CDS Start-End: 407-784

SEQ ID NO: 176767 - DNA, 508 bp, Homo sapiens; identical to SEQ ID NO: 176762
  Payload ID: 14692
  Gene Symbol: RPS25
  Gene Name: ribosomal protein S25
  ENST ID: ENST00000631368
  CDS Start-End: 47-166

SEQ ID NO: 176768 - DNA, 1183 bp, Homo sapiens
  Payload ID: 14693
  Gene Symbol: RPS26
  Gene Name: ribosomal protein S26
  Uniprot ID: P62854
  ENST ID: ENST00000356464
  CDS Start-End: 315-662
ctgcatcgtccagaattgcttccgagtcggcgcggcgcaaggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaatattgcatgttaagtgtatctgtgccagataaggtggggattttgtgtgttagaccaagtgtgaagtgacacacattattttcatggggaagaaagcttattcatgtaatttaatttttttcttttttttttttttttttttgagacggagtctttgtcgcccaagctgaattgcagtggcgtgatctcagctcactgcaacctccgtctcccgggttcaagtgattctcctgcctcagcttcttgagtagctgggattacaggtgtctgccaccatgcctggttaatttttgtatttttggtagagatggggtttcactatgttgtccaggctggtcttgaacttctgacctcagttaatccaccagccttggcctcccaaagtgctgggattacaggcttgagccacctcgcctagctatttatgtaaattaaactttaattgtggtcgt

SEQ ID NO: 176769 - DNA, 623 bp, Homo sapiens
  Payload ID: 14693
  Gene Symbol: RPS26
  Gene Name: ribosomal protein S26
  Uniprot ID: P62854
  ENST ID: ENST00000552361
  CDS Start-End: 207-554
ggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcaccgtctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaa

SEQ ID NO: 176770 - DNA, 350 bp, Homo sapiens
  Payload ID: 14694
  Gene Symbol: RPS27
  Gene Name: ribosomal protein S27
  Uniprot ID: P42677
  ENST ID: ENST00000368567
  CDS Start-End: 39-293
gctcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaa

SEQ ID NO: 176771 - DNA, 625 bp, Homo sapiens
  Payload ID: 14694
  Gene Symbol: RPS27
  Gene Name: ribosomal protein S27
  ENST ID: ENST00000392558
  CDS Start-End: 36-236
cctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggtgaggagacggcttgctgtagtggggaaagcactggacctcaacagttggaaaatgttgtagtgttagctgtctcgtatccttgaagctgtgcagcagcttcagtttcttcgcctgtggaaaatattttccctgatactcttaaaatttgaatgtatgagactggcaaagttttgcatcttaggaggagtgattcatttcaccgtgatctctcatcacatttcacatacaacccctacgtttttttgtgttgggaaacaatgtaatggatgatgagttgggcataagtgcaggaaagacgggtgtaatagaggaaaaaaatgttatctgcttttctttcaggatgctataaaatcaccacggtctttagccatgcacaaacggtagttttgtgtgttggctgctccactgtcctctgccagcctacaggaggaaaagcaaggcttacagaaggtaaatggtttactaatgtgat

SEQ ID NO: 176772 - DNA, 1071 bp, Homo sapiens
  Payload ID: 14695
  Gene Symbol: RPS27A
  Gene Name: ribosomal protein S27a
  Uniprot ID: P62979
  ENST ID: ENST00000272317
  CDS Start-End: 325-795
cccctcgacctccttttaaaaattctcttagccacgttgattgtacgggaaaagcctttttaaaacatcttttacgttgcttaaacctacagtttcgaaagcattccgaaggctaaagtgagaaataagcccaggctagggagaggagaaacgaagttcacgtcctagtctggcaccgggttggattgtcgctgggacggcagtcaggcatttggtgtggtcgcctaaggggtgggtccttcggcgggagctccgggaaaccccgtgggcctgcgcggcgttcttccttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaacatttattgttgggttttattgcagtaaaaagaatggtttttaagcaccaaattgatggtcacaccatttccttttagtagtgctactgctatcgctgtgtgaatgttgcctctggggattatgtgacccagtggttctgtatacctgccaggtgccaaccacttgtaaaggtcttgatattttcaattcttagactacctatactttggcagaagttatatttaatgtaagttgtctaaatataa

SEQ ID NO: 176773 - DNA, 705 bp, Homo sapiens
  Payload ID: 14695
  Gene Symbol: RPS27A
  Gene Name: ribosomal protein S27a
  Uniprot ID: P62979
  ENST ID: ENST00000402285
  CDS Start-End: 224-694
aagacccagactcttccctaggctgggagagactcggcggttgaaagcagggaggcgctacaggagagaaagggctgaacccccgcttccgcagatttcacctatttttcagtttgcctggagcaggccacgcaaattcccttcccttgaaggcccaaggagcgtctggtagattgctgattctctgcccatcaccgcttctggaagtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagtt

SEQ ID NO: 176774 - DNA, 796 bp, Homo sapiens
  Payload ID: 14695
  Gene Symbol: RPS27A
  Gene Name: ribosomal protein S27a
  Uniprot ID: P62979
  ENST ID: ENST00000404735
  CDS Start-End: 148-618
ggcgttcttccttttcgatccgccatctgcggtgggtgtctgcacttcggctgctctcgggttagcaccctatggtgccttctcttgtgatccctgacctaacctgtctcttccttttcctcaacctcaggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaacatttattgttgggttttattgcagtaaaaagaatggtttttaagcaccaaattgatggtcacaccatttccttttagtagtgctactgctatcgctgtgtgaatgttgcctctggggattatgtgacccagtggttctgtatacctg

SEQ ID NO: 176775 - DNA, 422 bp, Homo sapiens
  Payload ID: 14695
  Gene Symbol: RPS27A
  Gene Name: ribosomal protein S27a
  ENST ID: ENST00000449323
  CDS Start-End: 105-422
gccacgttgattgtacgggaaaagcctttttaaaacatcttttacgttgcttaaacctacagtttcgaaagcattccgaaggctaaagtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattat

SEQ ID NO: 176776 - DNA, 6434 bp, Homo sapiens
  Payload ID: 14696
  Gene Symbol: RPS27L
  Gene Name: ribosomal protein S27-like
  Uniprot ID: Q71UM5
  ENST ID: ENST00000330964
  CDS Start-End: 398-652
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaatcccctctttttctttttttaaaatatatttgagtatgccatacatttatatatatggtgtatatgaatttggtttaaacattttaaaatttattctgattagtttgtgtctttttttttttttttgagagagagagtcctgctctgtcactcaagctggagtgcagtggtgcgatctcggctcactgcaacctccgcctcccaggtccaagcaattctcttgccttgtcctcccaagtagctgggattataggcacacaccaccatgcctggctaatttgtgtctcattttcaagagtagaaaccctaaatattttattttcattccttttccaaattgctatgaatgggattaaaggattacagatgtaaagtctattatttgtgaattctaaatgtagttctgctgttgtacctgtggaaacatcttaaagaagtacatattttgcacgtcctgcacgtgtaccccagaacttaaactataattaaaaagaatagtttcaaaaaaatacatattgatcacagtgtaatgccttggatttatgtggccttgctatactactatataatttaggacagtaactgctagctggggtgtgagttatttattggaagctcctttttagggtagaaaatttgaggagaaatctgaagtggcatgatttacccgcagaagtcctggttggggatagtagatggtgttgaattctctggcccagataggtgagcactcctgactacagatgtgtgttgagtggttctggtgcctgcctcattgtcattttcatagtttatgaagtaatcctggggagctgagacggggagtgtatccactcactatacaactcctcattggactaggaagatagtccagtttctactctgcttctatttgatttgttaccttgtggcaggtatttaaaacaggcatttcctatcaacaggtaggcctctaatgtgagcaactgatcctcttacatactgcttaaatcagagaactgttgcacaagaactaaagaatgatggcaagtttggggtgtatatagttgtataaggaaggctgggcgcagtggctcacacctgtaatcccagcactttgggagcctgaggcaggtggatcacctgaggtcgggagttcaagaccagcctgaccaacatggaaaaaccccgtctctactaaaaatgcaaaattagctgggcgtggtggtgcatgcctgtaatctcagctaactcgggaggctgaggcaggagaattcgcttgaacctgggaggtggaggttgtggtgagccaagatcgtgccattgcactctagcctgggcaacaagcacgaaactccgtctcaaaaaaaaaaagaaaaaaaaaatatatatatatacatatatatgtagatgacccagagattctcagacttttagtttctgacatcattagaatctcagtaatttttttcaggccattccttggccaaaagaaatacctaacagttacatttattaacttatgttctaacaactctagtagccatttgaaaaaaactatacacacacaagagcaaaagtgatgtgatgatttttttaaaaatagagacagtgtcttggctctattgcccaggttggagggtcatagctcattgtgacctcaaactcctgggctcaagcaagcctcccacctctgcctcctgagtagcggagacttcaggcacgtgccaccacgcccgcctaatttttttgtagagatggggctctggctgtgttgcccaggctgtaaggaactcctggcctcaggtgatctgccttggcctaccaaagtgctgggattacaggtgtgagccactgtgcccagcctgatgtgataatttttatctcatccttaaatcatcacagttactaatggaatgtgtgtgccttttgggctccatacagtttctcaaaattgaaatcagattggacaccattgtccttatttcttccacattgatttttgcatggtgctttttgtcatagcagtggctccaaacccagcttcacaaggataggatgccatcaaagggaatgtagtgccatatcatattgaaactgaacttcctggaactagtagtttatacaaaagatgcgtcagtgtcaagtgtttttcctgaggtactccaaggcacttcagcttgcacagtttaggatacttggctataaggagagacagtgggatgacagcttttgatgagaaggaatcaaacctatgatgaggactaatctaacaaaccctgaaaattcccttggaagtattttttaaaaaaggattatactttaaagaccacatctaagggctgggcgcggtggctcacacctataatcccagcagtttgggaggctgaggcaggcagatcacttgcagtcaggagttcgagaccagcctggccaacacagtgaaaccccgtctctactaaacatacaaaaattagctgggcgtggtggtgtacacctgtagtcccagctacttgggaggctgaggcacaagaattgcttgaaaccaggaggcagaggttgcagtgagccaaaatcgcaccactgcacttcagcctgggtgacagcgtgaagctgtgtctcaaagaaagaacacatctaaggatttacatggcattgggaaacgaatggtgtattaagttttactttattattaatctagatggtattactggttttgaaaagtgctgaataggacaccaggactttcccaaacttcagggtcagccacatacattattatatactgaatgttttaaatattatttatattgacttcatattttaatgtaaatatatttgtaaaggaaaccttccataaacttaatataaatttatttttaggggaaggcttcctaaatggaaaaaccagttacataaagatagctaaaaataggccgggcgcagtggctcacgcctataatcccagcactttgggaggccgaggcgggtggatcacgaggtcaggagatcgagaccaccctggctaacacggtgtaaccccgtctctactaaaaatacaaaaaattagccgggcatggtggtgggcgcctgtagtcccagctacttgggaggctgaggcaggagaatggcgtgaacctgggaggcggagcttgcagtgagccaagatcacgcctctgcactccagcctgggtgacagagcaagactccagctcaagaaaaaaataaataagctaaaaataaaatgaaattcttggcttctggcctgatgagatgacaaatggttttgtgtctggtcgttcctgtaagtcatctgataaagctctaattcctttctgttttatttttctggagatatgattcagatactataaaatccaaacttctgtgatgtaaaagtcagtagtttttactatatttacaaggttgtgcaaccattactactgtctaatcccagaccattttcatcaccttagaaagaaacttcatacctatcagcattcactccctattcttccctcctctcagccattggcagccactaagctacttttgtctccatggatttgcttcttctcaatatttcatataatgctatttcgtataaatggaatcacatggtatgtagcttctgtatgtttcacttagcataatgttttcaagggctgtccatgctgttgcatgtatcaatatttcattcctttttttgacaatattctgtgtaataatatacaatgtttatccattcatcagttgatagatacttagagtgttttcactttttatttatttatttttgagatggagtcttgctctgttccctaggtggagtgcagtggcgtgatctcagctcactgcaacctcctccacctcccaggcttgagtgaccctctggcctcagcctcccgagtagctggaactacaggcacgtgccaccacaccccgctaattttttgtattttttgtagagatggggtttcgccatgttgcccaggctggtcttgaactccttgcctcaggccatccgcccacctcagcctcccaaagtgctggcattacaggtgtgagccactgcatccggccaaataaagtattcttaatgacatctgcaaaatccattttgctatgtaaggtaacatattcgtaggttctggggattagggtgtgggaatctttagagggccattattctgctaccacagaatataaagttgtaaaattctaccccatatttggaaactgagattcttaaattatgtctttgtaattctcttttttctttttctttcttttttttttttttttttgagacggagtcttgctccgtcgcccaggctgaagtgcagtggcgcaatctcagttcaccgcaagctcctcctcctgggttcacgccattctcctgcctcagcctccagagtacctgagactacaggcgtgtgccaccacgccgggctaatttttttaaagtatttttagtagagatggggtttcaccgtgttagccaggatggtctcgatctgctgacctcgtgatccgcctgcctcggcctctcatgtcttcgtaattttccatggaaaaaaacttaaatctttggaaggaatagagtacattattgcattttacaaagaaaaggataacttttatagaataatgaccttgtattcttttaggattttacagctactttttcacaactataggcatagaaaatgacatcaggggccgggcgcggtggctcacgcctgtaatcccaacactttgggaggcccaggcggcggatcacgaggtcgagattgagaccatcctggccaacatgatgaaaccgcgtctctgctaaaaatacaaaaattagctgggcgtggtgtcgggcgcctgtagtcccagctactcgggaggctgaggcaggagaattgcttgaacctgggaggcggagcttgcagtgagcccagatcgtaccactgcactccagcctgggcgacagagcaagactgtctcagaaaaaaaaaaaaaaaaaaaaaaaagaaatgacatcaggtcatggtgtttgctattgatcgacacttaaatagcctttgaattttgtttcaaaggagatgccagaattgcaaattttctctgctgatttgtgtcctactgattctggctcgctttccccctacactactagggctactctcactttcacacctagcaaaacttcacctttcaaagaatttaggcagaatagtcctaatttagttaataagctttcattttaaatcttagggaagcagtgttagtttcagttattctataggaacagaaattggagctgccacagccttttgaaccagagcccggcagaccctcagcttcagccctgctcagtgttttgtgtctatgaaagtctttttaattttctcattacacattttatatatcatgctatgtatttagaacagaggggttgtgtaagattatgactctatgttctttatcttgtctttgtattaatttgaagttgtgttttttctttatttgtagccaactaattaaaataccaacatatttatttttattcatttttatgtgacaaacttttaaactgaagactgcatcaataaaattgcatgccattaaatatg

SEQ ID NO: 176777 - DNA, 970 bp, Homo sapiens
  Payload ID: 14696
  Gene Symbol: RPS27L
  Gene Name: ribosomal protein S27-like
  ENST ID: ENST00000439025
  CDS Start-End: 95-388
atcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaaggtatatcatttggcattctccaacccagtgatgagattgatgattataaatgtctctatcttcactgaaaagtttaaagaaatcttaatgattaccaaaataacttatctttcattgtgtgctttcagtaaagaatggcctgttcaaatggatatatttatactcttgaccttgcagtgaactccattgacttatttttcttagtttagaacacatttattcacttagtttgcttaacttggaataaattaagtcagaatagaagcaaaagaataactacatgttataggacatgcagatttatttatttatttatttattattttttttttttattaggagtctcgctctgtcacccaggctggagtgcagtggcgccatctcagctcactgcaacttctgcctccccggttcaagtgattctcttgcctctgcctcccaagtagctgggaccacaggcgcgtgccaccatgcctggctaattttttgtatttttagtagaggtggggtttcactgtgttagccaggatggtcttgatctcctgacctcatggtctgcccgcctcggcctcccaaagtgctgggattacaggcatgagccacctcgccggccaggacatacagatttttaaaaccatatagaattttaa

SEQ ID NO: 176778 - DNA, 528 bp, Homo sapiens
  Payload ID: 14696
  Gene Symbol: RPS27L
  Gene Name: ribosomal protein S27-like
  ENST ID: ENST00000411926
  CDS Start-End: 197-355
agaacaaagcaaacctaaggcacagccataccccgcagaaaacttcgaaatctgcgccttgaaaagggaagccaaaaggatacgagcctctttcataatctctctgttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatg

SEQ ID NO: 176779 - DNA, 923 bp, Homo sapiens
  Payload ID: 14696
  Gene Symbol: RPS27L
  Gene Name: ribosomal protein S27-like
  ENST ID: ENST00000455271
  CDS Start-End: 586-744
aggttgcgcagcgtcttcgcgcgtggcgggcatgtagtgacttgcccggtcaccgcggcgcggctggccctgcaggggcgtgggctgcaattcagaggcggtggctgggaggggaacagttctctgtgtagcttatgagcggtcttggtctttgaggatgcccctgaggttgtgatctttgggtcttttggctttcccagtgattggtgtttctcgccccctctgccttctttcggaagcgatttcctacttgttttccttttttaaaaactgtcctcgttgttgccttatatattaattccgtcaaggacggtcgctcagcaagaattcctgtcagatcagctgttgagccacaggagcaaaaatcacccaggcgctgacgttgtctggtctacttcagcagtttctactctaagcgagtccacagtcggggtcactttctttgcttagcacctcgacttcgcgcagttttcatcgaagacagttcattacgcattggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 176780 - DNA, 681 bp, Homo sapiens
  Payload ID: 14696
  Gene Symbol: RPS27L
  Gene Name: ribosomal protein S27-like
  ENST ID: ENST00000462430
  CDS Start-End: 200-502
aggacaaagtttgccttaccatatgtttcctgatcgtgcgaaagcccttttctagggacttggagaacacaagtattatgaaaagtactgatgaaagttattaacaggtttcgaaaaataactttactatctgacgtgttgcttctgccgaggatgaccgttattcctgtttttgcatgtatatttcacgtatggttaaatgtgccagcgttgtggtttaaaactaatagtaataatatgcttctttgttcagttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 176781 - DNA, 693 bp, Homo sapiens
  Payload ID: 14696
  Gene Symbol: RPS27L
  Gene Name: ribosomal protein S27-like
  ENST ID: ENST00000635699
  CDS Start-End: 356-514
gcagatcgcttgcagcttgctagctgtgtgggctgggaggtctggtagggctgagcttgcaagaggatcaacatgcctgacggtcgctcagcaagaattcctgtcagatcagctgttgagccacaggagcaaaaatcacccaggcgctgacgttgtctggtctacttcagcagtttctactctaagcgagtccacagtcggggtcactttctttgcttagcacctcgacttcgcgcagttttcatcgaagacagttcattacgcattggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 176782 - DNA, 1326 bp, Homo sapiens
  Payload ID: 14697
  Gene Symbol: RPS28
  Gene Name: ribosomal protein S28
  Uniprot ID: P62857
  ENST ID: ENST00000600659
  CDS Start-End: 32-241
ctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagttaactcaggttcttgtctgggttatacgactagggtttctccaggtttcttgagtggctcccaggcggtcaccgatcctccgcactctggaaatcctggccgtgcggtcttgccaaacgaagcttttcctttttgaggcggggggtcgtgtttgtcgattgcaccctctaccccaaacaaaacacaagcgtagtaggaatgttttattagcaaagaagtttcagagagtgggtggatcagggctctatcacttggtccccacctcaccttggtggggccagagtgagccccttcctgccacagtcaccccaactgaaattgcctttctcttcggccagtgttagcctctgagcaggggaccctggacccttctgtgcgccaaaggctgaggtgactgacgaggagatctccccacagctaggtgtagtgagccagacgaggcagcttactgaacctgggggttctctccattgtcaccgcattctccttcaccaggtgtggctgtctgggagccagggggtgactcgctctggagagaggggaaaagaggggggcctgctgcaatctccttgaggcaggaaacgtgggattcagccccagcctcacttagtggaggttcttttaccatggacccaggctgcctggtttgtatccaacctctgccccttctgacctggaagaggcgcttgaccttcctcccacatcccttccagtggggtgagtacaggtgttcctcagtttacaatgggttacattccggtgagtacatcataggttgaaagtattgcaagttgaaatgtgtttaatacacctaatctcccaaacatcacagcttagcatggtccatcttaagcttgttcagaacgccttagcctgtagttggggaaactcgtctaacacgaagcctgttttaataaagtattgaatgtcttatgtaatttattgaa

SEQ ID NO: 176783 - DNA, 296 bp, Homo sapiens
  Payload ID: 14698
  Gene Symbol: RPS29
  Gene Name: ribosomal protein S29
  Uniprot ID: P62273
  ENST ID: ENST00000245458
  CDS Start-End: 31-201
cttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttca

SEQ ID NO: 176784 - DNA, 7062 bp, Homo sapiens
  Payload ID: 14698
  Gene Symbol: RPS29
  Gene Name: ribosomal protein S29
  Uniprot ID: P62273
  ENST ID: ENST00000396020
  CDS Start-End: 31-234
cttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagaaagacctgagctgtcttccttggcactgcctatggaggtgacacccatctcctccatcatggccatcctgagaccgctcgcgaagcccaagatcatcaaaaagagcaccaagttcactgggaaccagtcagactgatatgtcaaaattaagggtaactggtggaaacacagaggtattaacaacagggttcatagaaggtttgagggccagatctatgcccaacattggttatgggagaaacaaaaagacaaagcacatactgcccagtggcttctggaagttcctggtccacaacgttaaggagctggaagtactgctggtgagcaacaaatcttactgtgttgagatcactcatgatgtttcttccaagaactgcaaagccatcttggaaagagcagcccaggtggtcatcagagtcaccaatgccaatgccagcctgcacagtgcagaaagtgaatagacagtgaatgtgtttgttttattggggtttaaataaaaccaataaaactgtaaaaacaaaaacaacaaaaaccagagaccctggcttttggacagttgttcgtgtggctaatgcccccaacagttttattttttaaaattttatttatgtattgtttttgagatgaagtcttcctctgactggagtgcagtgatgcaagctcagctctctgcaacttccacctcccaggttcaagtgattcttctgtctcagcctcccaagtggctgggattacaggtgcccactaccacacctgactaatttttgtatttttgtagagatggggtttcatcctcttggccaggctggtttcgaactcctgacctcaagggatcctcccacctcagcttcccaaagtgctgggatcacaggcttgtattagttcattttcacactgctgataaagacatacctaagactgggaagaaaaataggtttattggactcacagttccatgtggctggggatgcctcacaattatggtagaaggcaaaaggcacttcttagatggcagcggcaagcaggaaatgaggaagacatgaaagcagatatcccttataaaaccatcagttctcgtgatacttactcactaccatgagaaagtatgggggaaaccgctcccatgattcagttatctcccaccgggtccctctcacaacatgtggggattatgcgagtacaattcaagatgagatttgggtggggacacagcccacaaaccataatcaaggcatgagccactgtgcctggccttcaacagttttaaagcagcctgcttgcataacctctgctaggacatcgttcttaaaaactatctttaatggtaattggtgtattagggatttgggtttttaggtaggcagagaaaaaacacttctagtggtatgattaagaagggtataataaagtgttttaatttcctcaatattgacaaaaattgaaaaaaagaggccaggcaaagtggctcatgcctgtaatcctagccttttgggaggctgaggcaggaggatggtttgatgccaggagttccagaccagcctgggcaacatcaggagatcccctatctaccaaaattaaacaaacaaaaaaacccaaaaacaattagccaggcgtggtggtgcatgtctgtagtcccagtttctcaggaggctgagatgagaggataacttgagcccaagaggtccaggtttcaatgagtcatgtttgtatcacttaaaaaaaaaaaaaaggctgcactattagctgtttctcaggaaggttaatgtagaacataaaaggctcagtttgtagatagactgagtatatgtgtgtgtaggaatcaaggctatacagggtccaaaaattagcctagattatgtgtgctagttccaggtatcttctatcttttagaattttaaaagaatagaggcagaaagtcacaagcttaatctagatgaggtaattatcatttaatgtcttgaacataaagtaatttgctaaattagaatttattttaatttttttggacatggccttgctctatcacccagactggcattcagtggcacaaacatggcttattgcaacctcaacctcctgggctcaagtaatcctcctacctcagactccaagtagctaggaccataagtgtgcaccacaatgcccagctaatttttataaaatttttcgtagagatggaagtctcaccatgttgctcaggctggtctggaactcctgggctcatgcaatcctcccttcctagtctcccaaagtgttgggatcacaggggtgagccactgtgttcagccagaaaataatttagagaagccagaactggcttcctttggtgaaaattctttgagcagattccagactggaccttctgactgttataaataaatggtggattcccattatttgtttgtgggacagaaatattgaaggcctgtagaaccataatgccttccccttccttctgtcactcacccacttcatttctcctattaggccccttagaaagagatccctgatgccaggcacagtggcttacgcctgtaatcctagcagtttgggaggctgaggcgggtggatcacctgaggtcaggagttaaagaccagcctggccaatgcagtgaaaccccatctttactaaaaatacaaaaaaattagccaggcatggtggcgagtgcctgtaatctcagctactcaggaggctgaggcaggagaatggcgtgaacccgggaggcggagcttgcagtgagcggagatcaggccgctgcactccagcctgggcgacagagcgagactccgtctcaaaaaaaaagataaagaaagagatccctgactgcctgtatagtttgagaaccactgatcctggggcaaggactcaaagtctctggctctagaagtggctggtgtggacctcaaatggaccctgttctaagagtccaaaggacacatttcaggaagctgtgctctaagcctaaatgaccaaccttgccttcactttggacatataccatctgatcatcttcctcgatttctgttctttgctcaggccttccaatttcttcgtgggtgacccctccttaccagtgctttgctctgagtcagctcaccagacccagcaggctgccactaaaggtttattgtaaaaccttgattaattcagataaccttgaaatacttacataacatcactgacaaataggaaagggagtgcatttccattgatagagactatggctagagttactaaggtctggaaaaaaggcaggagagtgaagtatctggagacgtagggagagaaagagactggtgttaagagaaaaatcacgcctttttcctgcttgtatcttacagtggttctgccaccagtaatgcaggatcccactgatctctctgaacacattttaggacaggtccatattcgggagctgactttgtaacttcttactgtatatagtttaggttcgaatgggatcaccataggtgtgcttatgaccttaactgtaacagcgatgaaataaaaaaaatggtttagtttaataataatgttgtaagagtgtaagtaccagtagcttcatgtacattctacaacccaataataattatgctgaccgtgtaaacagctccctcgtgtagactgagactccattgccaaacatcaagcattaacagcaagtgctagaaaaatcaataagcctttacccagggaaccaaagatatgtgggttactaaaacccctaacagttgcccataaagagtaatatctcattattttaatgccaaaggaggtttttgtttcatttcctaaataataacaagatcgcatattaaaggacgagttgatggagtgataaacattcctggcagcacagacaaatcaacaagagactaaaataaaaagaaatgaaacttgcctcttggcaatctgtttagttgaatttcatagactgagtctggttcaccctggattttcttttcacacacccacacgtcccatttcatgatgacacttgtgcatctattcttcctttgatggtaattaactcttattaacattcatgaagactaagtgtgagcctctagcacagatgacatattcagacaaccacaaaaagatagggtttataaaaactaatgcatatttggaactgaggccaaaagataaagatggtccactccaacagtgctgacatgcttgagaaatccaaggggtgttgacctaatgtaaaaaggatataggagacaaattttaccattgtgtaattttgtcttaggccagttctgtcaaatatagcttctgaaattctgaatagtcctctgcccagtgtggtttaattgttggtgttgtcaggactcttggggagaagtcacctttctcttttttttttttttttttttgattctaactctgttgtccaggctggagtgcagtggtgccatcttggctcactgcagcctctgtctcctgggttcaagagattctcctgccttaacttagcctctggagtagctgggattacaggtgcgcaccattacatccagctaatttttatatttttagtggagatggggttttgtcatgttggccagtctggtctcaaactcctgacctcaaggatctgtctgctttggtctcccaacgtgctgggattacaggcatgagccaccacgcccagcctatttttttattttttgtattttcttttggtaatctctttctcttgctttttctttctttctctttctttctttctttctttccttctttctttctttctttcttcttttttttctttggagacagggtctcactgtgtcatgcaggctggagtgaagtcgtgtgatcttggcttactgcagcctcaacctgctgggctcaatgcaatcttcccacctcagcctcccaagtatctgggaccacaggcgtgcatcaccagcatggctaatttttgtatttttggtgagacaaacttttgccatgttgcccaggttggccttaaattcctgggctcaagagatccacctgccttggcctcccaaaatgctaggactgcaggcgtgagccaccatgccaggccagggaaatctctttaaacacaattttctttaaagttttctacatggtcaggagacttcattatctgatttctgagtactatagcttctttattgccaagggagcaaagcatgatgacaatgaccacttctcatttgtgtccttcattatagattttctaaatacacttgttccttgttaatgactttaatttgttccagaaaactccaccactgagttaaaagctattaagtgaaaaaattccattaagttttcggaaaaaattatttattctatgacactacagggtacttgagtaattttcacaaaaagaagaatatactagttaaactttgaaaaaaagctcataaaagtaatgtacaataatttgaaagtattctgacctcaaccggtatattgaaattcaattcttgcactaattagggttagagaagaccccacaagttaaagggcatgatcccaaacgaggttgtcctcacttttgatgccagtcacactttgggagtccccagtcaattggctacaaatctaggggtttggctgggtgccgtggctcacacctgtaatctgagcacattgggaggccaaggcaggtggatcacctgaggttaggagttcgagagcagcctggccaacaccgtgaacctcgtatctactaaaaatacaaaaattagccgggcatggtggcagtcacctgtaatcccagctacttgggaggctgaggcacgagaatcgcttgaacctgggaggcagaggttgcagtgagctgagatggtgccactgcacttcagcctgggcaacagagtgagactgggtctcaataaaaaataaaaataaaataaaacaataaaacgtaggggtttctgaagatttccttcaggtttgccgatttgctagaatgactcacattactcaggaagatgctgtatttacaattgttttattatgaaggatataagttaggaccagccaatggagagacacataaagtaaggtctaggagggcgctggatgcgaagctttcatgtcctgcattgtggaatcgggtgtgtcaccctctcaacacattgatatgttcaccaaccaggatgcttcaccatgcttcggtatctaaagtttttattggggtttcattatatatgtataattgattgaatcactggccaagtgattgaactaaatctccaccctaccccttactctgggtgtcaggctgactcaaagcaccagctatgtaatcacatggttgttctcgctggtaactggcctccatcttgggtcatctcatcttccagcccaaattcaggtgtgatccaagaggctcatgaaaaacaaagatatccctgttacttagggaattctaattattttgagtctgcctcctaggaaccagagacaaaagccagtcaaattctttactataaaacagaaagcatgtgaaaacatactgtgcacgctatgtcacacaacaaacacaagtctattgaacttgccaatggtggagtgttggttggtaggagaggtctgagggcatcattctttgcaaagtgtattctttctgtaccattttcttgaccaattttcaccttttctggggattattcctgttttgcactcaaactactcttaaaaataaagttacagtgcaggaaaacttctttagggcacaataaaggctaaactcgtggaaatggtactcattcatctgcacagaatgaagtctctcaagatgtttccttttattcctactcagttggtgcatgtacccaaaataaacattttgagttcatccaaacacaattca

SEQ ID NO: 176785 - DNA, 488 bp, Homo sapiens
  Payload ID: 14698
  Gene Symbol: RPS29
  Gene Name: ribosomal protein S29
  ENST ID: ENST00000557111
  CDS Start-End: 239-400
gttcggggaggattccgagggtttcagctgttgacgctttacgcgttgcgggcgcacgtcgggccgctgtttcccgagggaaggcaggtgtgcctctgcgttacagggaaaggcacttagaactgtctgagtggccccgtaagccagcgagggcgcatttcccggcgcggacgggctgctggtggttttggtggctgctctccggaggcacacctggcacgtcgaaggggggctttatatggctgtatttgacttggcaattcctgctgaacaaataatttttcatggcggtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaa

SEQ ID NO: 176786 - DNA, 238 bp, Homo sapiens
  Payload ID: 14698
  Gene Symbol: RPS29
  Gene Name: ribosomal protein S29
  Uniprot ID: P62273
  ENST ID: ENST00000611563
  CDS Start-End: 71-238
ctcaaaaatttgaagagcgcatgcgtgggccagcttcttccttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagctagat

SEQ ID NO: 176787 - DNA, 907 bp, Homo sapiens
  Payload ID: 14699
  Gene Symbol: RPS3
  Gene Name: ribosomal protein S3
  Uniprot ID: P23396
  ENST ID: ENST00000278572
  CDS Start-End: 19-798
gcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagttgaaaataatggtgatggtaacaggatatcccttgcttcctttaaagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagtttcttacttttgtgctttatttggtttcagggtctccttggcagctgtattctggagtctggatgttgctctctaaagacctttaataaaattttgtacaaagac

SEQ ID NO: 176788 - DNA, 903 bp, Homo sapiens
  Payload ID: 14699
  Gene Symbol: RPS3
  Gene Name: ribosomal protein S3
  ENST ID: ENST00000422465
  CDS Start-End: 276-586
tttcctttcagcggagcgcggcggcaagatggcagtgcaaatatccaagaagaggaagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacacaaggtctgactagactgttcagtattcagactgaggggcatgttggcctctggagcattacatatcttcttggttttaaccatacttgtggtatttgcaagggccagaacagtaagacccaagcagagccaaccagagaaataatatttgtgtgatagagaaggctgatagcaagcaaggcagcaccttgattc

SEQ ID NO: 176789 - DNA, 771 bp, Homo sapiens
  Payload ID: 14699
  Gene Symbol: RPS3
  Gene Name: ribosomal protein S3
  ENST ID: ENST00000526248
  CDS Start-End: 1-408
caaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacacaa

SEQ ID NO: 176790 - DNA, 737 bp, Homo sapiens
  Payload ID: 14699
  Gene Symbol: RPS3
  Gene Name: ribosomal protein S3
  ENST ID: ENST00000532872
  CDS Start-End: 19-366
gcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacacaa

SEQ ID NO: 176791 - DNA, 796 bp, Homo sapiens
  Payload ID: 14699
  Gene Symbol: RPS3
  Gene Name: ribosomal protein S3
  ENST ID: ENST00000530721
  CDS Start-End: 30-164
ctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacacaa

SEQ ID NO: 176792 - DNA, 473 bp, Homo sapiens
  Payload ID: 14699
  Gene Symbol: RPS3
  Gene Name: ribosomal protein S3
  ENST ID: ENST00000528439
  CDS Start-End: 31-306
cctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacacaa

SEQ ID NO: 176793 - DNA, 1878 bp, Homo sapiens
  Payload ID: 14699
  Gene Symbol: RPS3
  Gene Name: ribosomal protein S3
  ENST ID: ENST00000530164
  CDS Start-End: 30-383
ctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggaggtaagtgtcctgagacctaatggtcatgaccttttgtgtgtatcaacatacatgtctgccatttgttaatttagcagatgaactgttacaaagttacaggatctgctagtctcccagggttataataagatactaagtcatgccctcactgaactggcaggctaacaagactactaaagcagcaagaactgtaaagggtggtcagtcctgtaatggagaagtgttctgggtgctttgggagttaaacacaaatagaactgtccaaggaggggaccaactcctgttggtcttcttgagaaggctttacaaagagccctgttgcggggggcggggcagtgggcaatgaggaataattaggcctgttactgggtgtgttacgtatccctaggtagaagtgccttagtactagttaggataccatgaaactttagtagcaatcattcaaatctgcttagtgtgttcactcttaagatggtattgtgaagagataagatagacctgatgcaaaatagcttaaaatctagacacttaacctctgagttgcatgcagatagtagtaatgtgagggtctactggtaagatttcaacaggaagttctttgtgcagtttgactgtatgtaaaggcactgaaatgccttgcctagaggaatgacaggaaagctgtgctgtaggaaggttgactggtagggatgggtagtgtaggcaaggctctaggtaaggacatagaaaagacggcttacctggtttgagtgccagctaggctgcttagaacaatggttctcaagattaatgccagccccagacccaccaaatgggaaactggatgtgtgactcagcaatctgtcttaataacccctccacatgctgtttgcacacattgaagcaagttaatgaacctctcagcctgggatctgttatcttctaaggtggaccattataccacctctcagttgtggaatattaagtaagataatgtgaaagggcctggaggtggctagctctccagttagtatctcgcagagcgtaaactgccgaatgagttggggggtaggtcatattttaaagtgttttatcagcgttctaatagcaagatagccaggatcctaggtgggtaagctttcctagtgaatgagacttcggaggttgcagagtatttcaagggaccacaaagtgggtaattgtggagtgtaaatgtggttctcagttttggttatacatgagaatcacccagggagcatttttaaatagatattcctggactttgcacatttaattggcctagagtagggcctagatgtcagggtttcttttgttttttattttagccttctgaggtgattccagtatgcagccagggttggaaagtacatatttaggagcttgacatacttgatgaatattaccctaaggttcggaatgataggtgtggaagagaattggtattcttggggccggactctggtcaaattattctccattaaaggaacattgaaaaccaa

SEQ ID NO: 176794 - DNA, 710 bp, Homo sapiens
  Payload ID: 14699
  Gene Symbol: RPS3
  Gene Name: ribosomal protein S3
  ENST ID: ENST00000526608
  CDS Start-End: 12-707
gcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacag

SEQ ID NO: 176795 - DNA, 866 bp, Homo sapiens
  Payload ID: 14699
  Gene Symbol: RPS3
  Gene Name: ribosomal protein S3
  Uniprot ID: P23396
  ENST ID: ENST00000524851
  CDS Start-End: 6-737
gcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacaggtatgtctgcaagggcaggggcctcttggggcataatagggtccttccgagtctttctgttaatacttgtatcccacattctggtaagcgtttggtgaataaaaatttcatttatttgctttatgt

SEQ ID NO: 176796 - DNA, 2097 bp, Homo sapiens
  Payload ID: 14699
  Gene Symbol: RPS3
  Gene Name: ribosomal protein S3
  Uniprot ID: P23396
  ENST ID: ENST00000531188
  CDS Start-End: 63-794
cctttatactcacttccgcccgcgagccacttcctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacacaaggtctgactagactgttcagtattcagactgaggggcatgttggcctctggagcattacatatcttcttggttttaaccatacttgtggtatttgcaagggccagaacagtaagacccaagcagagccaaccagagaaataatatttgtgtgatagagaaggctgatagcaagcaaggcagcaccttgattcgttgtcctgtagttcaggattgtaggtttagaagagggatatgtttgagtttttcctatgcataaggcgatccacgttgcacatagaaagtgaatataaatggccattatattttgtgtcatgctgtgctctaagtgttctttacatatgtactcgttaatcaacctctctaaagtgtaaaggaaatttgcttgcaccactgaaggcacataaggctcagaagtaaatttgcctaagcagtataaagctatcattagaatccacattcctaagttgtgttctcttaggggatcatggaaccagtcattggtactacaggctattatgttctggagaactgtgaagaacatttaaattgtctctgattttatctatcaatgttttgaagtattttctaccagtgtctgtacttcacaagaaattcggcactattttttcaggcaaaactagtgagggacaggttggcttgaaaatcatgagactgttgttaaatcagatgctggttgatcacagaggggacttccagggaaagctgttatcaggtggctgcttcctggtgatgcagcctggctgatgagataaccctggctccacagatggcttagcaggtgctgtgatgatttggttttcttctcaattagactgagctgcacatggtgtttatattgcttggcacatggtaagggcttaatatttgaggtaattatgtagggcgtacactgacaagtatctgacccccccttcctttttgactcataaattggtcatcttaaccatttaagtgtacacttctatagtgacagagttagccctctgtccaagggatttgcatctgtggattcaaccaactttgggtcaaaaataatcaaaaaggatggttgtgtgtgtattgaacatgtagacttatttttcttattttcaaaatactatattttcttgtcacttattttcttgtacactgcagttgtaacagctatgtagcatgtacattaggtattaaaagtaatccagtgaagattgaaagtctaa

SEQ ID NO: 176797 - DNA, 390 bp, Homo sapiens
  Payload ID: 14699
  Gene Symbol: RPS3
  Gene Name: ribosomal protein S3
  ENST ID: ENST00000527273
  CDS Start-End: 7-390
ggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggc

SEQ ID NO: 176798 - DNA, 639 bp, Homo sapiens
  Payload ID: 14699
  Gene Symbol: RPS3
  Gene Name: ribosomal protein S3
  ENST ID: ENST00000528847
  CDS Start-End: 531-639
atgatgacgagtctgacttggggatgttctctttgcccaggtggcctactctgtgctgcgttctgtggcacagtttaaagagccctggttgaagtaatttcctaaagatgacttagaggcatttgtctgagaagggttgctgcactcctgttggaacaagggtttggaaccattggttggagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagacc

SEQ ID NO: 176799 - DNA, 564 bp, Homo sapiens
  Payload ID: 14699
  Gene Symbol: RPS3
  Gene Name: ribosomal protein S3
  ENST ID: ENST00000534440
  CDS Start-End: 18-494
cggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgt

SEQ ID NO: 176800 - DNA, 421 bp, Homo sapiens
  Payload ID: 14699
  Gene Symbol: RPS3
  Gene Name: ribosomal protein S3
  ENST ID: ENST00000525690
  CDS Start-End: 1-101
agtttgtcgctgatggcatcttcaaagctgaactgaatgagtttcttactcgggagctggctgaagatggctactctggagttgagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacacaa

SEQ ID NO: 176801 - DNA, 1307 bp, Homo sapiens
  Payload ID: 14699
  Gene Symbol: RPS3
  Gene Name: ribosomal protein S3
  ENST ID: ENST00000525933
  CDS Start-End: 1-515
agtttgtcgctgatggcatcttcaaagctgaactgaatgagtttcttactcgggagctggctgaagatggctactctggagttgaggtgcgagttacaccaaccaggacagaaatcattatcttagccaccagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacaggtatgtctgcaagggcaggggcctcttggggcataatagggtccttccgagtctttctgttaatacttgtatcccacattctggtaagcgtttggtgaataaaaatttcatttatttgctttatgtgggagaatacaagttgaaacctggggtctatttaacccttggttccaatgggacaggtgttgcctttattctttccagaaagaagttcctgcttttactcgtgtatatgaaatagttttcccttatcctcccttatttgctcaaaatttttggctcagtgcaacctctgcctcccatgttcaagcaattctcctgtctcagcctcccgagtagctgggattataggcacctgccaccaagcccagctaatttttgtgtttttagtagagacggggtttcaccttgttggccaggctggtctcagactcctgacctcaggtgagccactgtgcttggctgctcaagattttctaggcacttttgctattctgtcctttagcagcccctgtaaaacactaacaagcctcctgtggtcaacacttggggtttttttgtttataggtgttgtctctccaggtgccttgtattttttttttttatatgaaaaaggacaaacccttatgtatgcattttattaatgttgctgcaaaccctaagtgggagtgtgtatccatttggtaaatcaggaacttaataactctggtaaagtttcttacttttgtgctttatttggtttcagggtctccttggcagctgtattctggagtctggatgttgctctct

SEQ ID NO: 176802 - DNA, 1306 bp, Homo sapiens
  Payload ID: 14699
  Gene Symbol: RPS3
  Gene Name: ribosomal protein S3
  Uniprot ID: P23396
  ENST ID: ENST00000527446
  CDS Start-End: 18-749
cggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagcctcttccatgagtggggagcccgctgcttgtctccagctcctagcagtgagtcctgataatctcaaatttaaggacagtaactttgtctgggatgagtgtgggaaaggatgtgtttgggaacagacgcgagcctgcagaggtgtttgtaaccatctctttctaagtggtgggaagcagacattttattctttaactgttaatatatatagtgtgtgttttttatgcatgaaatattttatagtttttaaaaatgcccacactactattttgaaagtaaatgaggtaatgtatgtgtcagaacccaatacccaaagcgatcgtagtaagaggtggggcctttgggaaggcattaaattgcttagggaatgagggtggaaccctcatgaatgagattagagccttataggagaggttggagggagttgcctggcctccctctcccatgtgaagactcagcaagaaaacattatttaggaagcagagagccctcatcaaacaccagatctgctggccacctgatctggcactttccagccttcagaactgtgagaa

SEQ ID NO: 176803 - DNA, 531 bp, Homo sapiens
  Payload ID: 14699
  Gene Symbol: RPS3
  Gene Name: ribosomal protein S3
  ENST ID: ENST00000530170
  CDS Start-End: 1-371
ttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggaggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagc

SEQ ID NO: 176804 - DNA, 934 bp, Homo sapiens
  Payload ID: 14700
  Gene Symbol: RPS3A
  Gene Name: ribosomal protein S3A
  Uniprot ID: P61247
  ENST ID: ENST00000274065
  CDS Start-End: 81-875
tagacggcgcgccccgcccccgtacgcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctgaa

SEQ ID NO: 176805 - DNA, 480 bp, Homo sapiens
  Payload ID: 14700
  Gene Symbol: RPS3A
  Gene Name: ribosomal protein S3A
  ENST ID: ENST00000503002
  CDS Start-End: 286-480
ttttggctctctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatggcgaggattccagtcggattgtgcgggccgtggcgggttggtgcacccaggaacgcggcctggaggggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggc

SEQ ID NO: 176806 - DNA, 686 bp, Homo sapiens
  Payload ID: 14700
  Gene Symbol: RPS3A
  Gene Name: ribosomal protein S3A
  ENST ID: ENST00000512797
  CDS Start-End: 1-573
aacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacag

SEQ ID NO: 176807 - DNA, 985 bp, Homo sapiens
  Payload ID: 14700
  Gene Symbol: RPS3A
  Gene Name: ribosomal protein S3A
  ENST ID: ENST00000514682
  CDS Start-End: 258-941
ccttttggctctctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatggcgaggattccagtcggattgtgcgggccgtggcggggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 176808 - DNA, 587 bp, Homo sapiens
  Payload ID: 14700
  Gene Symbol: RPS3A
  Gene Name: ribosomal protein S3A
  ENST ID: ENST00000508783
  CDS Start-End: 211-587
tctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatgggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgcca

SEQ ID NO: 176809 - DNA, 576 bp, Homo sapiens
  Payload ID: 14700
  Gene Symbol: RPS3A
  Gene Name: ribosomal protein S3A
  ENST ID: ENST00000509736
  CDS Start-End: 95-532
tccgcccttttggctctctgaccagcaccatggcggttggcaagaacaagcgccttacgaaaggcggcaaaaagggagccaagaagaaagtacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 176810 - DNA, 845 bp, Homo sapiens
  Payload ID: 14700
  Gene Symbol: RPS3A
  Gene Name: ribosomal protein S3A
  ENST ID: ENST00000512690
  CDS Start-End: 15-632
ctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 176811 - DNA, 674 bp, Homo sapiens
  Payload ID: 14700
  Gene Symbol: RPS3A
  Gene Name: ribosomal protein S3A
  ENST ID: ENST00000507327
  CDS Start-End: 94-674
acaagcgccttacgaaaggcggcaaaaagggagccaagaagaaaggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagct

SEQ ID NO: 176812 - DNA, 614 bp, Homo sapiens
  Payload ID: 14700
  Gene Symbol: RPS3A
  Gene Name: ribosomal protein S3A
  ENST ID: ENST00000505243
  CDS Start-End: 310-614
cccttttggctctctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatggcgaggattccagtcggattgtgcgggccgtggcgggttggtgcacccaggaacgcggcctggagggtcggtgttgagtagcggcagggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctg

SEQ ID NO: 176813 - DNA, 671 bp, Homo sapiens
  Payload ID: 14700
  Gene Symbol: RPS3A
  Gene Name: ribosomal protein S3A
  ENST ID: ENST00000515792
  CDS Start-End: 1-627
aagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaaacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 176814 - DNA, 572 bp, Homo sapiens
  Payload ID: 14700
  Gene Symbol: RPS3A
  Gene Name: ribosomal protein S3A
  ENST ID: ENST00000515818
  CDS Start-End: 25-312
ccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcaggacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatg

SEQ ID NO: 176815 - DNA, 862 bp, Homo sapiens
  Payload ID: 14700
  Gene Symbol: RPS3A
  Gene Name: ribosomal protein S3A
  ENST ID: ENST00000506126
  CDS Start-End: 149-832
cgccttacgaaaggcggcaaaaagggagccaagaagaaagttgaaaaatacagtaagaattgatctgcaatggaacttaagcatcttcttaaaatccagggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaa

SEQ ID NO: 176816 - DNA, 762 bp, Homo sapiens
  Payload ID: 14700
  Gene Symbol: RPS3A
  Gene Name: ribosomal protein S3A
  ENST ID: ENST00000510993
  CDS Start-End: 93-762
gttgagtagcggcaggtcggctgcctttcccaggccttctggtccttgcgcgcgtcgcgtttgagccggcttgccggcgcgactcggctggaatggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactgggg

SEQ ID NO: 176817 - DNA, 1526 bp, Homo sapiens
  Payload ID: 14701
  Gene Symbol: RPS4X
  Gene Name: ribosomal protein S4, X-linked
  Uniprot ID: P62701
  ENST ID: ENST00000316084
  CDS Start-End: 106-897
ggctgagctgggcggagcagctgaaaatccggcgcgcgcagtctccagccccaatttctacgcgcaccggaagacggaggtcctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagcattttggttttgtgggttgtttttttttttaattcagtttcctgctattttactgtataacatgaacagtgattaagttctcaggcaggcttaggcagtctgttattggctgggcttagttagtggtgggaagtagaagataccagacttgggaaaggaacagcaactaaccaaggagtagaaagagccaagaaatcccggagtatttatctcccccgccttgacttggccaagaacttctctacacagtggacccctctgccctgttaagttcccttggctttctaaaaatctgccctcattttcttctccagtctgtattgcactagcccatccacaagcctggctcatctgtttttcccactcctgtgcccatcttgccaaacgcaggatgaaaatctccagttgccattaaaggtggtcataaatgggctgttgatgttgcaaagcattgcagttccttggacttagtgcccttattctccagctgccgctgcagtcctcaactctgtttttcagaggacagagatgtagaacataaacttgttcttgcttgtccaaa

SEQ ID NO: 176818 - DNA, 1305 bp, Homo sapiens
  Payload ID: 14702
  Gene Symbol: RPS4Y1
  Gene Name: ribosomal protein S4, Y-linked 1
  Uniprot ID: P22090
  ENST ID: ENST00000250784
  CDS Start-End: 140-931
ttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttaatgtgttttttcccccttgtggataatagtagggtttgaatttgctcatgattttggcactgtcttaagatctctaggaataccacctatacttcctctgaccctccagtaaataaacctttgcttccctcatacatgttacccacaccatctctgtgggcagagtgatggagtagcattccaaaacgaagtacaaaaaacgtatgacatttcagaaaggacggcattcttttgtggaagctatgggagatggtcttagttttcttgcttgttcacattattggtagaaattaaatcctgtggctgtaggaaa

SEQ ID NO: 176819 - DNA, 811 bp, Homo sapiens
  Payload ID: 14702
  Gene Symbol: RPS4Y1
  Gene Name: ribosomal protein S4, Y-linked 1
  ENST ID: ENST00000430575
  CDS Start-End: 25-811
gcactgtggacgctctcttgacggatgctagggagacccgccaagttttcaaaggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagata

SEQ ID NO: 176820 - DNA, 792 bp, Homo sapiens
  Payload ID: 14703
  Gene Symbol: RPS4Y2
  Gene Name: ribosomal protein S4, Y-linked 2
  Uniprot ID: Q8TD47
  ENST ID: ENST00000629237
  CDS Start-End: 1-792
atggcccggggccccaagaagcacttgaagcgtgttgcagcgccgaagcattggatgctggataaactaactggtgtatttgcacctcgtccatcgacaggtcctcacaagctgagggaatgtcttcccctgatagtcttcctcaggaatagactcaagtatgcattgactggagatgaggtaaagaagatatgtatgcaacacttcctcaaaattgatggcaaggttcgagtggacatcacataccctgctggattcatagatgtcatcagcattgagaaaacaggtgagcatttccgcctggtctataataccaagggctgttttgctgttcatcgtatcacagtggaagaggcaaagtacaagttgtgcaaagtgaggaagattactgtggggacaaagggaattccacacctggtgactcatgatgctcgaaccattcgctacccagatcctctcatcaaggtgaacgatactgtgcagattgatttagggactgggaagataaccagctttatcaaatttgacacaggcaatgtatgtatggtgattgctggagctaacctcggtcgtgttggtgtgatcacaaacagggaaagacatcctggttcttgcgatgtggtacatgtgaaggatgccaacggcaacagctttgccacaaggatttccaacatttttgtcattggcaatggtaataaaccttggatttccctgcccaggggaaagggcatccgacttactattgctgaagagagagacaagaggctggctgccaaacagagcagtggctaa

SEQ ID NO: 176821 - DNA, 740 bp, Homo sapiens
  Payload ID: 14704
  Gene Symbol: RPS5
  Gene Name: ribosomal protein S5
  Uniprot ID: P46782
  ENST ID: ENST00000196551
  CDS Start-End: 73-687
ctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcc

SEQ ID NO: 176822 - DNA, 1203 bp, Homo sapiens
  Payload ID: 14704
  Gene Symbol: RPS5
  Gene Name: ribosomal protein S5
  Uniprot ID: P46782
  ENST ID: ENST00000601521
  CDS Start-End: 533-1147
gggctgcaacccctcgcgcgggctccccggccgtggaggacacaaggacaaacacgaagggtccccgacctgccgaccccctcctcccggacaccgcgcgtagcctgtaggctacctccgcgctccacccagagacgggtcgcgctgctcccgccgccgcaaccccgggccctcgtgccggcggtctcccctcttccacgggcgagattactgcatagcagaggcgcccacaagacagggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttggcccgcggcgcgcggcctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccacc

SEQ ID NO: 176823 - DNA, 536 bp, Homo sapiens
  Payload ID: 14704
  Gene Symbol: RPS5
  Gene Name: ribosomal protein S5
  ENST ID: ENST00000598098
  CDS Start-End: 78-482
gcggcctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcca

SEQ ID NO: 176824 - DNA, 718 bp, Homo sapiens
  Payload ID: 14704
  Gene Symbol: RPS5
  Gene Name: ribosomal protein S5
  ENST ID: ENST00000596314
  CDS Start-End: 118-718
taggctacctccgcgctccacccagagacgggtcgcgctgctcccgccgccgcaaccccgggccctcgtgccggcggtctcccctcttccacgggcgagattactgcatagcagaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggcca

SEQ ID NO: 176825 - DNA, 800 bp, Homo sapiens
  Payload ID: 14704
  Gene Symbol: RPS5
  Gene Name: ribosomal protein S5
  ENST ID: ENST00000598495
  CDS Start-End: 73-750
ctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcagatgactacaacttctgtcatgagaggactccttcaccagaaggagcatcacatctcacatatggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtccca

SEQ ID NO: 176826 - DNA, 1520 bp, Homo sapiens
  Payload ID: 14704
  Gene Symbol: RPS5
  Gene Name: ribosomal protein S5
  Uniprot ID: P46782
  ENST ID: ENST00000596046
  CDS Start-End: 850-1464
gcggcgcgtggtctacgccgagtgacagagacgctcaggctgtgttctcaggtgagaccgccgcggggccggggatcctagggacggttcatggtctttcggggatagtgccccgcggcctgggccttttctcattaggtctcatttctgtctctggaaaagaaaatgtagaagaaacgggcgcgggccgagttactcttgacttctttctggtgctccgccgcttctagcttttccccatagcggggcttggggaacttggtttgaactatgcggttgtactctgagataggaagtttccatttcttagggacacgatgccctcttttgctctgtgtaactttccccccgtaatagcagcccctagagccttcatactgtcggtcaagaatcgaaacctttgggttgattgtgccacacggtacctaccgtggtccttgatgtcatataacggtcccgcctcacggccaaagaaacagtccgagacggaacgttgacttgggtcaaagaccatgtaaatcgcgagattgtggtttgaattacagcccatgcagtgtgaggacgtatggcatctgctgagccattataccttggtcccagtgcagcagctgttgactggtggctgccaagtcttgggcccaggggttctaggtgaaagacagatgcttcttgctgacagctgagtaatttttctagtgcttgaaaacacgttcacggcctttcttggtcctttgcgaccccccagttcatcactagatggcggctagcctcagagttgggaatgagtgcgcctttgctccatgctagctgagctctgacgtttttttcctgtcatcaccctgtcccaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccacc

SEQ ID NO: 176827 - DNA, 892 bp, Homo sapiens
  Payload ID: 14705
  Gene Symbol: RPS6
  Gene Name: ribosomal protein S6
  ENST ID: ENST00000380381
  CDS Start-End: 42-317
ctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaa

SEQ ID NO: 176828 - DNA, 863 bp, Homo sapiens
  Payload ID: 14705
  Gene Symbol: RPS6
  Gene Name: ribosomal protein S6
  ENST ID: ENST00000315377
  CDS Start-End: 199-855
aagatgaaggtaggtgatggtggcgagtgttagactgggtttggggaacgtgaatcgagtcccagaacgcggcattgcctcagttccagcactccaggatcctggctttagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagatttttt

SEQ ID NO: 176829 - DNA, 1355 bp, Homo sapiens
  Payload ID: 14705
  Gene Symbol: RPS6
  Gene Name: ribosomal protein S6
  ENST ID: ENST00000380384
  CDS Start-End: 676-1332
gctgcttcaagatgaaggtaggtgatggtggcgagtgttagactgggtttggggaacgtgaatcgagtcccagaacgcggcattgcctcagttccagcactccaggatcctggctttaggtggagaagggtctcaagtaggagaaggctcgcctttctggggcatggagctttttggccgaacggatggcaggcgattgcggctggagccgcggcgggccgggagcgccatggtggcgtccccgcgcccagccgggacggatgcggcgtgttgcccagtttgcggcaggcctgtggtgcggctcttgaccccggctttcttgcttcgggagggtgaacggctgcggagtgccctcgcccccagagtcattccgcggggcttgaggggaaaacgtcctgctgagtgcggcgcttcttgactgctactctgctttcacgtgcttttagtgagtacagtcggcatcttatatttcctgcttgtgtggaggcaacatgaaaggctttttgcagtggaattaactttgtagatggctctacaattacctgtatagatagtttcgtaaactatttccccccttttaatccttagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaat

SEQ ID NO: 176830 - DNA, 1387 bp, Homo sapiens
  Payload ID: 14705
  Gene Symbol: RPS6
  Gene Name: ribosomal protein S6
  Uniprot ID: P62753
  ENST ID: ENST00000380394
  CDS Start-End: 60-809
gctaagcggaagttggccctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctgatctctgttgacttttcattgctgatagaaaactacataaatgaagagagggaaagttaggtcatagaaaatggggatatgtatatatggtattccaatggtggataaagtcagacctattgtgtgtggtagtggaagacaaggtcagtgtacaggggttcctttcaggggatgggtggcacaggaagggattctgagcataagacacctgcctcttcagaatggcatggaacttaggggaaatgatgaggactattaatcttttttatatagtttatttttgaggaatatagctctttaaagcactatacacaatttaatacatgaaaattgaccttgtgaagatgaacatgtcttttttaaaaggtaacttttaaggcatagttttagtggatacctagttttagtggataccatccactaaatggtttttaagccatttcaaatttgttttaacaaagcttttcaactccagtgaattgttaggctgttcacacactgaaaaggaaatgactaaaaacattcttggatcagtgaaaaa

SEQ ID NO: 176831 - DNA, 5454 bp, Homo sapiens
  Payload ID: 14706
  Gene Symbol: RPS6KC1
  Gene Name: ribosomal protein S6 kinase, 52kDa, polypeptide 1
  Uniprot ID: Q96S38
  ENST ID: ENST00000366959
  CDS Start-End: 151-3315
gctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccggataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgttacttatggtgatgagattttcagatttgaactaatctatttgacgtgatttagaaagaatgtaagtattcacacatctccaaacatttgtatttgttacttctttttgttgctaaggtagctcctgtagttatgcattgttgcaaaaatttacaaatgttttaaaagtgttaacatctgtttttttttaaacgttagccaaagaagaagtcactatttccaagttagaaaccaccagaaataattgaaatttttgatatgttctaatcttctttgcatttttgagatctgtgtgagagcccaaccccactccaggagcatctgtacagcttccatctgccatcgaccaggtcctctcatcaaattaaatggaacagaaaatgctctagtgaaacaaaggaaatgtgcaagcatttttcctttttctattattctatttccctttttcctttttggcccccttataatccaaaccccagctgaaaggctgcaacaacaccaggttggggagcaggtcaccaggatcatagttcagtcaaaatgacatcactccctggaactagatttcaactcactagtcccctggcctcataacaggaacttatgcaggtgagacacaagaatgacttcctgtgtaggactagtaggaaatctgcaagtacttagagctggccattacagaacttccttccagaagtgccctgtgacatgaaagtaggacttcacaactaaggtgaagatccctgccctaccacatgatttgagtctcttggattcaaaggacattaatgtcaacagatggttgccatgtcagtctgttgacacaattccattgcttcagtttctccccttttctctctatatgtttggttggagcttgtgcctaatgtaaatacatcattcataattagaatggacattaattattttagtaataaacacaggataaatagctttggggtgatgaaccagagtctgtttttattttatggtgtgtacatattttaagctgtacttctgtgaatggtactgatttttgtggttgttttttttttatattttgtttgtttaagcagaagagtggaatatggggtcaaaatcataaaagaagttgccatg

SEQ ID NO: 176832 - DNA, 5490 bp, Homo sapiens
  Payload ID: 14706
  Gene Symbol: RPS6KC1
  Gene Name: ribosomal protein S6 kinase, 52kDa, polypeptide 1
  Uniprot ID: Q96S38
  ENST ID: ENST00000366960
  CDS Start-End: 151-3351
gctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgttacttatggtgatgagattttcagatttgaactaatctatttgacgtgatttagaaagaatgtaagtattcacacatctccaaacatttgtatttgttacttctttttgttgctaaggtagctcctgtagttatgcattgttgcaaaaatttacaaatgttttaaaagtgttaacatctgtttttttttaaacgttagccaaagaagaagtcactatttccaagttagaaaccaccagaaataattgaaatttttgatatgttctaatcttctttgcatttttgagatctgtgtgagagcccaaccccactccaggagcatctgtacagcttccatctgccatcgaccaggtcctctcatcaaattaaatggaacagaaaatgctctagtgaaacaaaggaaatgtgcaagcatttttcctttttctattattctatttccctttttcctttttggcccccttataatccaaaccccagctgaaaggctgcaacaacaccaggttggggagcaggtcaccaggatcatagttcagtcaaaatgacatcactccctggaactagatttcaactcactagtcccctggcctcataacaggaacttatgcaggtgagacacaagaatgacttcctgtgtaggactagtaggaaatctgcaagtacttagagctggccattacagaacttccttccagaagtgccctgtgacatgaaagtaggacttcacaactaaggtgaagatccctgccctaccacatgatttgagtctcttggattcaaaggacattaatgtcaacagatggttgccatgtcagtctgttgacacaattccattgcttcagtttctccccttttctctctatatgtttggttggagcttgtgcctaatgtaaatacatcattcataattagaatggacattaattattttagtaataaacacaggataaatagctttggggtgatgaaccagagtctgtttttattttatggtgtgtacatattttaagctgtacttctgtgaatggtactgatttttgtggttgttttttttttatattttgtttgtttaagcagaagagtggaatatggggtcaaaatcataaaagaagttgccatg

SEQ ID NO: 176833 - DNA, 4082 bp, Homo sapiens
  Payload ID: 14706
  Gene Symbol: RPS6KC1
  Gene Name: ribosomal protein S6 kinase, 52kDa, polypeptide 1
  ENST ID: ENST00000543354
  CDS Start-End: 595-3252
tctctgctgacccggaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacatt

SEQ ID NO: 176834 - DNA, 4227 bp, Homo sapiens
  Payload ID: 14706
  Gene Symbol: RPS6KC1
  Gene Name: ribosomal protein S6 kinase, 52kDa, polypeptide 1
  ENST ID: ENST00000543470
  CDS Start-End: 833-3397
tctctgctgacccggaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagggagaatcctgaaccaacctatccatgaacatactctctgccattttcttagtccttttttcgggaaaactcttttataataacaactgttggtgaaccattcatctgaaaactcttataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacatt

SEQ ID NO: 176835 - DNA, 4188 bp, Homo sapiens
  Payload ID: 14706
  Gene Symbol: RPS6KC1
  Gene Name: ribosomal protein S6 kinase, 52kDa, polypeptide 1
  ENST ID: ENST00000614059
  CDS Start-End: 794-3358
tctctgctgacccggaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggtattttaatggtcttacttttttgatctaatctcatttaatcatgattctcattgctaataaaatatgatttgaaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacatt

SEQ ID NO: 176836 - DNA, 4022 bp, Homo sapiens
  Payload ID: 14706
  Gene Symbol: RPS6KC1
  Gene Name: ribosomal protein S6 kinase, 52kDa, polypeptide 1
  ENST ID: ENST00000615329
  CDS Start-End: 1387-3192
tctctgctgacccggaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacatt

SEQ ID NO: 176837 - DNA, 5375 bp, Homo sapiens
  Payload ID: 14707
  Gene Symbol: RPS6KB1
  Gene Name: ribosomal protein S6 kinase, 70kDa, polypeptide 1
  Uniprot ID: P23443
  ENST ID: ENST00000225577
  CDS Start-End: 22-1599
ggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaacataaatagaagtgatttatttttttattatcttaaagataggaaggaattagtatacgtatcaggtgtataaatggtttaaatttattttaacatgtcagatgtgttcaagttgtcatataaataaactatgtatgtaaggaa

SEQ ID NO: 176838 - DNA, 5479 bp, Homo sapiens
  Payload ID: 14707
  Gene Symbol: RPS6KB1
  Gene Name: ribosomal protein S6 kinase, 70kDa, polypeptide 1
  Uniprot ID: P23443
  ENST ID: ENST00000393021
  CDS Start-End: 428-1846
gtttggcttcacggaaccctgtacgcatgctcctacgctgaactttaggagccagtctaaggcctaggcgcagacgcactgagcctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggagggggaagcgctcagctgttagaagtgacagctgaaaacttctgtcgggagtagcactgccgctgctgttacagccaccaggagttttatttcgggagcaagggggctctgctgcatcttccaatcttccaggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaac

SEQ ID NO: 176839 - DNA, 1982 bp, Homo sapiens
  Payload ID: 14707
  Gene Symbol: RPS6KB1
  Gene Name: ribosomal protein S6 kinase, 70kDa, polypeptide 1
  Uniprot ID: P23443
  ENST ID: ENST00000406116
  CDS Start-End: 41-1396
tggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatat

SEQ ID NO: 176840 - DNA, 1913 bp, Homo sapiens
  Payload ID: 14707
  Gene Symbol: RPS6KB1
  Gene Name: ribosomal protein S6 kinase, 70kDa, polypeptide 1
  Uniprot ID: P23443
  ENST ID: ENST00000443572
  CDS Start-End: 56-1564
ctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaaga

SEQ ID NO: 176841 - DNA, 622 bp, Homo sapiens
  Payload ID: 14707
  Gene Symbol: RPS6KB1
  Gene Name: ribosomal protein S6 kinase, 70kDa, polypeptide 1
  ENST ID: ENST00000592726
  CDS Start-End: 436-622
cggtcccttgcatttcttcttttttttttttgagacagagtctcactctgttgcccaggctggactgctgcagtggcgcgatcttggctcactgcaagctccgcctcacgggttcacgccattctcctgcctcagcctcccgagcagctgggactacaggcgcccaccaccacacctggctaattttttatatttttagtagaggcggtgtttcaccatgttagccaggatggtcttgatctcctgacctcgtgatctgcctgcctcggcctcccaaagtgctgggattacaggcatgagccaccgtgcctggtggtcccttgcatttctatatgaaatttaggatcagcttgtcaatttctgcaagaaaggaacctggggttttgataggattcagttgaatccgtgaccaatttgggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaata

SEQ ID NO: 176842 - DNA, 909 bp, Homo sapiens
  Payload ID: 14707
  Gene Symbol: RPS6KB1
  Gene Name: ribosomal protein S6 kinase, 70kDa, polypeptide 1
  ENST ID: ENST00000489824
  CDS Start-End: 48-206
ccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggagggggaagcgctcagctgttagaagtgacagctgaaaacttctgtcgggagtagcactgccgctgctgttacagccaccaggagttttatttcgggagcaagggggctctgctgcatcttccaatcttccaggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctggcttgagtggaacgctcttcacaccagttgttcctaacagaaccattctcattgcggctttctttccttgaattgcttttacttggcagaaatctccatggctttggggcatttacatcaaaaggggatcatctacagagacctga

SEQ ID NO: 176843 - DNA, 2808 bp, Homo sapiens
  Payload ID: 14707
  Gene Symbol: RPS6KB1
  Gene Name: ribosomal protein S6 kinase, 70kDa, polypeptide 1
  ENST ID: ENST00000472940
  CDS Start-End: 100-522
aactttaggagccagtctaaggcctaggcgcagacgcactgagcctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaagatgatctcttttcctttaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctggccttttctaacaaagaagctgcatttaagagccttagggatgaagtgcccttttttggaggaggctcactgagccgtgttggaggctgtgtttgtggtcgtgctggctgtgaaactgcctcagtcctctaggacacaccctctccatcctggagtaatctgcaggattgcaacattgttatgcagccagtattgcagtgccttgtgcttttcgaatccagacagggttgattcagccctttattcttttgagcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagtagggattggcatctttggtgttttgtggggaagataatgctagttttatgtatttctgagggttatatgtagttgcttataagtttagcttattttgtgacttgtaacttcaaaaaggtgattaatttatcaatccagcaaagtctagtcccctcaacttttcttcctgctttttttttcctaggctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacgactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaa

SEQ ID NO: 176844 - DNA, 1733 bp, Homo sapiens
  Payload ID: 14708
  Gene Symbol: RPS6KB2
  Gene Name: ribosomal protein S6 kinase, 70kDa, polypeptide 2
  Uniprot ID: Q9UBS0
  ENST ID: ENST00000312629
  CDS Start-End: 46-1494
gcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggcccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatggtgctga

SEQ ID NO: 176845 - DNA, 461 bp, Homo sapiens
  Payload ID: 14708
  Gene Symbol: RPS6KB2
  Gene Name: ribosomal protein S6 kinase, 70kDa, polypeptide 2
  ENST ID: ENST00000420069
  CDS Start-End: 402-461
agtgcgcggccaggtacgggccgacgggcccgcggggccggcgccgccatggcggccgtgtttgatttggatttggagacggaggaaggcagcgagggcgagggcgagccagagctcagccccgcggcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaagcttctacctggctgagatcacgctggccctgggccatctccactcccagggcatcatctaccgggacctcaagcccgagaacatcatgctcagcagccagggccacatcaaactgaccgactttggactctgcaaggagtctatc

SEQ ID NO: 176846 - DNA, 1806 bp, Homo sapiens
  Payload ID: 14708
  Gene Symbol: RPS6KB2
  Gene Name: ribosomal protein S6 kinase, 70kDa, polypeptide 2
  Uniprot ID: Q9UBS0
  ENST ID: ENST00000528964
  CDS Start-End: 43-507
cggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgtagactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggcccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggc

SEQ ID NO: 176847 - DNA, 466 bp, Homo sapiens
  Payload ID: 14708
  Gene Symbol: RPS6KB2
  Gene Name: ribosomal protein S6 kinase, 70kDa, polypeptide 2
  ENST ID: ENST00000524934
  CDS Start-End: 53-466
agtcagtgcgcggccaggtacgggccgacgggcccgcggggccggcgccgccatggcggccgtgtttgatttggatttggagacggaggaaggcagcgagggcgagggcgagccagagctcagccccgcgtccaacctgaacgggagcggggaggtatcctggcaccttccttggctcttacccctcggtttctcacaggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacac

SEQ ID NO: 176848 - DNA, 850 bp, Homo sapiens
  Payload ID: 14708
  Gene Symbol: RPS6KB2
  Gene Name: ribosomal protein S6 kinase, 70kDa, polypeptide 2
  ENST ID: ENST00000556575
  CDS Start-End: 64-525
ccgggactgtcagtcagtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaa

SEQ ID NO: 176849 - DNA, 957 bp, Homo sapiens
  Payload ID: 14708
  Gene Symbol: RPS6KB2
  Gene Name: ribosomal protein S6 kinase, 70kDa, polypeptide 2
  ENST ID: ENST00000525996
  CDS Start-End: 1-324
gtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtggcgagctcttcacgcatctggagcgagagggcatcttcctggaagatacggcctggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggcccccgtcagccccctcaagttctccccttttgaggggtt

SEQ ID NO: 176850 - DNA, 592 bp, Homo sapiens
  Payload ID: 14709
  Gene Symbol: RPS6KA1
  Gene Name: ribosomal protein S6 kinase, 90kDa, polypeptide 1
  ENST ID: ENST00000366866
  CDS Start-End: 33-368
ggggccctctggtcaccggcttgagccccaccatgcagaccccagcagatttccccagggttgagagagacttggttccctgtcccagaaaggtacagcagcaagaacccacagctctgcccttaaccccttcctggggatccctgccctgctgcctgcccgtgtgtctgccaggtgtcagacctatctgccctaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctg

SEQ ID NO: 176851 - DNA, 3202 bp, Homo sapiens
  Payload ID: 14709
  Gene Symbol: RPS6KA1
  Gene Name: ribosomal protein S6 kinase, 90kDa, polypeptide 1
  ENST ID: ENST00000374163
  CDS Start-End: 60-674
actgcggcagccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccagcgggactcggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtaatatacatgattcaaaagaaaaatattcatgaagaagtcttcctcccaccccagccccctctattcccatctataggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaagcacg

SEQ ID NO: 176852 - DNA, 3131 bp, Homo sapiens
  Payload ID: 14709
  Gene Symbol: RPS6KA1
  Gene Name: ribosomal protein S6 kinase, 90kDa, polypeptide 1
  ENST ID: ENST00000374166
  CDS Start-End: 144-2318
gcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaact

SEQ ID NO: 176853 - DNA, 3186 bp, Homo sapiens
  Payload ID: 14709
  Gene Symbol: RPS6KA1
  Gene Name: ribosomal protein S6 kinase, 90kDa, polypeptide 1
  Uniprot ID: Q15418
  ENST ID: ENST00000374168
  CDS Start-End: 155-2362
ctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaactgttgagttgaa

SEQ ID NO: 176854 - DNA, 498 bp, Homo sapiens
  Payload ID: 14709
  Gene Symbol: RPS6KA1
  Gene Name: ribosomal protein S6 kinase, 90kDa, polypeptide 1
  ENST ID: ENST00000403732
  CDS Start-End: 1-498
gctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatccc

SEQ ID NO: 176855 - DNA, 639 bp, Homo sapiens
  Payload ID: 14709
  Gene Symbol: RPS6KA1
  Gene Name: ribosomal protein S6 kinase, 90kDa, polypeptide 1
  ENST ID: ENST00000438977
  CDS Start-End: 1-348
aacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttct

SEQ ID NO: 176856 - DNA, 2596 bp, Homo sapiens
  Payload ID: 14709
  Gene Symbol: RPS6KA1
  Gene Name: ribosomal protein S6 kinase, 90kDa, polypeptide 1
  Uniprot ID: Q15418
  ENST ID: ENST00000526792
  CDS Start-End: 435-2366
aaattgctctgggattcctgccatggggattttacaggcactgctaggctgctcagaggttctctcgctgactcaccctctgaggtgaggaacactgccctctgcagcccctgtactgccaccccgctactaggaccggggcgcaaggtcctgggggtggtgctcagaggtggattcctttgcccaggcacgcccctgggaccaggcctccaaaggagaagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaac

SEQ ID NO: 176857 - DNA, 3023 bp, Homo sapiens
  Payload ID: 14709
  Gene Symbol: RPS6KA1
  Gene Name: ribosomal protein S6 kinase, 90kDa, polypeptide 1
  Uniprot ID: Q15418
  ENST ID: ENST00000530003
  CDS Start-End: 51-2210
agaagtaggaagagtaacggggccctctggtcaccggcttgagccccaccatgcagaccccagcagatttccccagggttgagagagacttggttccctgtcccagaaaggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccggaaccacagggccagagggagctggaacccgaggggccggggaagctgccagcccagaacacccctaatgagggtgtgagaagtgccttctccttccccaggatggactcttctcggctcaggctctgctggtggaaagcgattcactgtataaacttttttttatgaaaaaaatggcatcaaccaccatggatttttacaagatccatttgcctttctgggagcagaaacagccattgcggccccaggaggggaactgagtcacgctggggctctctgagactctttagagcagctttgggatcccaccctggggacccccacgattggccacctgtagccatctgcacacacctccgagacagtccagtgtcacctctctcagagcatctggctgtttagcagaactcattctatccccaatcagctccttttccgttctgttctgctgggagttctagaaccacttcctgctacaggaggggtctcatgtcctgctggcttccagcttcaggcaccagcatccaccttggctctgccagtggatcccctgcggtcaggctgggcagccccagagagaggatgtggaaagcactttttggctgacttcatctggggttggcaacaggacagagttcacaggaggccagtgggcgggccatgagggacagggtcttttttcatttcttcctcagctggttactcagggttcatctgtccatggcctttctaataaact

SEQ ID NO: 176858 - DNA, 544 bp, Homo sapiens
  Payload ID: 14709
  Gene Symbol: RPS6KA1
  Gene Name: ribosomal protein S6 kinase, 90kDa, polypeptide 1
  ENST ID: ENST00000529454
  CDS Start-End: 208-544
ctgtactgccaccccgctactaggaccggggcgcaaggtcctgggggtggtgctcagaggtggattcctttgcccaggcacgcccctgggaccaggcctccaaaggagaagaatggacagacctcaggggaagaagctggacttcagccgtccaaggtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactg

SEQ ID NO: 176859 - DNA, 543 bp, Homo sapiens
  Payload ID: 14709
  Gene Symbol: RPS6KA1
  Gene Name: ribosomal protein S6 kinase, 90kDa, polypeptide 1
  ENST ID: ENST00000525525
  CDS Start-End: 161-331
gaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaagcagctcctgacctcccttgagggctctgtggctccagtccctaagcgtgcagaaggccacctcttcctgtgccttttgaccccagggtcaaggtcaagcccctgaatgagctggtggaaaacttcctccttaacctcttgctgggaaggaagcagaatggacagacctcaggggaagaagctggacttcagccgtccaaggatgagggcgtcctcaaggagatctccatcacgcaccacgtcaaggctggctctgagaaggctgatccatcccatttcgagctcctcaaggttctgggccagggatcctttggcaaa

SEQ ID NO: 176860 - DNA, 2359 bp, Homo sapiens
  Payload ID: 14709
  Gene Symbol: RPS6KA1
  Gene Name: ribosomal protein S6 kinase, 90kDa, polypeptide 1
  Uniprot ID: Q15418
  ENST ID: ENST00000531382
  CDS Start-End: 50-2284
ccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccagcgggactcggatgagggcgtcctcaaggagatctccatcacgcaccacgtcaaggctggctctgagaaggctgatccatcccatttcgagctcctcaaggttctgggccagggatcctttggcaaagtcttcctggtgcggaaagtcacccggcctgacagtgggcacctgtatgctatgaaggtgctgaagaaggcaacgctgaaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacagcctgggtatcatttacagagacctcaagcctgagaacatccttctggatgaggagggccacatcaaactcactgactttggcctgagcaaagaggccattgaccacgagaagaaggcctattctttctgcgggacagtggagtacatggcccctgaggtcgtcaaccgccagggccactcccatagtgcggactggtggtcctatggggtgttgatgtttgagatgctgacgggctccctgcccttccaggggaaggaccggaaggagaccatgacactgattctgaaggcgaagctaggcatgccccagtttctgagcactgaagcccagagcctcttgcgggccctgttcaagcggaatcctgccaaccggctcggctccggccctgatggggcagaggaaatcaagcggcatgtcttctactccaccattgactggaataagctataccgtcgtgagatcaagccacccttcaagccagcagtggctcagcctgatgacaccttctactttgacaccgagttcacgtcccgcacacccaaggattccccaggcatcccccccagcgctggggcccatcagctgttccggggcttcagcttcgtggccaccggcctgatggaagacgacggcaagcctcgtgccccgcaggcacccctgcactcggtggtacagcaactccatgggaagaacctggtttttagtgacggctacgtggtaaaggagacaattggtgtgggctcctactctgagtgcaagcgctgtgtccacaaggccaccaacatggagtatgctgtcaaggtcattgataagagcaagcgggatccttcagaagagattgagattcttctgcggtatggccagcaccccaacatcatcactctgaaagatgtgtatgatgatggcaaacacgtgtacctggtgacagagctgatgcggggtggggagctgctggacaagatcctgcggcagaagttcttctcagagcgggaggccagctttgtcctgcacaccattggcaaaactgtggagtatctgcactcacagggggttgtgcacagggacctgaagcccagcaacatcctgtatgtggacgagtccgggaatcccgagtgcctgcgcatctgtgactttggttttgccaaacagctgcgggctgagaatgggctcctcatgacaccttgctacacagccaactttgtggcgcctgaggtgctgaagcgccagggctacgatgaaggctgcgacatctggagcctgggcattctgctgtacaccatgctggcaggatatactccatttgccaacggtcccagtgacacaccagaggaaatcctaacccggatcggcagtgggaagtttaccctcagtgggggaaattggaacacagtttcagagacagccaaggacctggtgtccaagatgctacacgtggatccccaccagcgcctcacagctaagcaggttctgcagcatccatgggtcacccagaaagacaagcttccccaaagccagctgtcccaccaggacctacagcttgtgaagggagccatggctgccacgtactccgcactcaacagctccaagcccaccccccagctgaagcccatcgagtcatccatcctggcccagcggcgagtgaggaagttgccatccaccaccctgtgaggcaccagggcattcgggccacagggcggtgctagcttgacacagtcagcatgcttcccagagggagcaggccgg

SEQ ID NO: 176861 - DNA, 500 bp, Homo sapiens
  Payload ID: 14709
  Gene Symbol: RPS6KA1
  Gene Name: ribosomal protein S6 kinase, 90kDa, polypeptide 1
  ENST ID: ENST00000526040
  CDS Start-End: 161-319
gaagtgctagtgccgcggcggcggcggcggacggcccagccggagcgcgaggggctcgggggggcgcggcggttcgggtcgcagagccagggaccccaggacccgggaggcggcgcagccggggccgccggaggagcgcgggtgacctggcggcggcgagatgccgctcgcccagctcaaggagccctggccgctcatggagctagtgcctctggacccggagaatggacagacctcaggggaagaagctggacttcagccgtccaagtacgtgaccgcgtccggaccaagatggagagagacatcctggctgatgtaaatcacccattcgtggtgaagctgcactatgccttccagaccgagggcaagctctatctcattctggacttcctgcgtggtggggacctcttcacccggctctcaaaagaggtgatgttcacggaggaggatgtgaagttttacctggctgagctggctctgggcctggatcacctgcacag

SEQ ID NO: 176862 - DNA, 543 bp, Homo sapiens; identical to SEQ ID NO: 176859
  Payload ID: 14709
  Gene Symbol: RPS6KA1
  Gene Name: ribosomal protein S6 kinase, 90kDa, polypeptide 1
  ENST ID: ENST00000628001
  CDS Start-End: 161-331

SEQ ID NO: 176863 - DNA, 3131 bp, Homo sapiens; identical to SEQ ID NO: 176852
  Payload ID: 14709
  Gene Symbol: RPS6KA1
  Gene Name: ribosomal protein S6 kinase, 90kDa, polypeptide 1
  ENST ID: ENST00000630838
  CDS Start-End: 144-2318

SEQ ID NO: 176864 - DNA, 500 bp, Homo sapiens; identical to SEQ ID NO: 176861
  Payload ID: 14709
  Gene Symbol: RPS6KA1
  Gene Name: ribosomal protein S6 kinase, 90kDa, polypeptide 1
  ENST ID: ENST00000627677
  CDS Start-End: 161-319

SEQ ID NO: 176865 - DNA, 498 bp, Homo sapiens; identical to SEQ ID NO: 176854
  Payload ID: 14709
  Gene Symbol: RPS6KA1
  Gene Name: ribosomal protein S6 kinase, 90kDa, polypeptide 1
  ENST ID: ENST00000625863
  CDS Start-End: 1-498

SEQ ID NO: 176866 - DNA, 3202 bp, Homo sapiens; identical to SEQ ID NO: 176851
  Payload ID: 14709
  Gene Symbol: RPS6KA1
  Gene Name: ribosomal protein S6 kinase, 90kDa, polypeptide 1
  ENST ID: ENST00000626401
  CDS Start-End: 60-674

SEQ ID NO: 176867 - DNA, 3186 bp, Homo sapiens; identical to SEQ ID NO: 176853
  Payload ID: 14709
  Gene Symbol: RPS6KA1
  Gene Name: ribosomal protein S6 kinase, 90kDa, polypeptide 1
  Uniprot ID: Q15418
  ENST ID: ENST00000629832
  CDS Start-End: 155-2362

SEQ ID NO: 176868 - DNA, 592 bp, Homo sapiens; identical to SEQ ID NO: 176850
  Payload ID: 14709
  Gene Symbol: RPS6KA1
  Gene Name: ribosomal protein S6 kinase, 90kDa, polypeptide 1
  ENST ID: ENST00000625391
  CDS Start-End: 33-368

SEQ ID NO: 176869 - DNA, 2596 bp, Homo sapiens; identical to SEQ ID NO: 176856
  Payload ID: 14709
  Gene Symbol: RPS6KA1
  Gene Name: ribosomal protein S6 kinase, 90kDa, polypeptide 1
  Uniprot ID: Q15418
  ENST ID: ENST00000631108
  CDS Start-End: 435-2366

SEQ ID NO: 176870 - DNA, 639 bp, Homo sapiens; identical to SEQ ID NO: 176855
  Payload ID: 14709
  Gene Symbol: RPS6KA1
  Gene Name: ribosomal protein S6 kinase, 90kDa, polypeptide 1
  ENST ID: ENST00000629099
  CDS Start-End: 1-348

SEQ ID NO: 176871 - DNA, 544 bp, Homo sapiens; identical to SEQ ID NO: 176858
  Payload ID: 14709
  Gene Symbol: RPS6KA1
  Gene Name: ribosomal protein S6 kinase, 90kDa, polypeptide 1
  ENST ID: ENST00000629025
  CDS Start-End: 208-544

SEQ ID NO: 176872 - DNA, 2359 bp, Homo sapiens; identical to SEQ ID NO: 176860
  Payload ID: 14709
  Gene Symbol: RPS6KA1
  Gene Name: ribosomal protein S6 kinase, 90kDa, polypeptide 1
  Uniprot ID: Q15418
  ENST ID: ENST00000628256
  CDS Start-End: 50-2284

SEQ ID NO: 176873 - DNA, 3023 bp, Homo sapiens; identical to SEQ ID NO: 176857
  Payload ID: 14709
  Gene Symbol: RPS6KA1
  Gene Name: ribosomal protein S6 kinase, 90kDa, polypeptide 1
  Uniprot ID: Q15418
  ENST ID: ENST00000628081
  CDS Start-End: 51-2210

SEQ ID NO: 176874 - DNA, 5824 bp, Homo sapiens
  Payload ID: 14710
  Gene Symbol: RPS6KA2
  Gene Name: ribosomal protein S6 kinase, 90kDa, polypeptide 2
  Uniprot ID: Q15349
  ENST ID: ENST00000265678
  CDS Start-End: 225-2426
gggaggcggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcaggttcttctctgtgtacctgcgcaggaagtcgcgctccaagagctccagcctgagccggctcgaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgcccgccctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggattttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgtaatctttttctagcctaacaataa

SEQ ID NO: 176875 - DNA, 2282 bp, Homo sapiens
  Payload ID: 14710
  Gene Symbol: RPS6KA2
  Gene Name: ribosomal protein S6 kinase, 90kDa, polypeptide 2
  ENST ID: ENST00000405189
  CDS Start-End: 334-2268
actgtttacagtagctgtgctggaaaccacatgctcctgccatggatgcagccgattcaggaacagacttgatcttcctaaggcattgcatgcaaatcctcatcaagctctagataaaattacctgcttcataaaacagaaaaggcacatatttcaaaatgaaatgaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctg

SEQ ID NO: 176876 - DNA, 596 bp, Homo sapiens
  Payload ID: 14710
  Gene Symbol: RPS6KA2
  Gene Name: ribosomal protein S6 kinase, 90kDa, polypeptide 2
  ENST ID: ENST00000507350
  CDS Start-End: 220-596
gaggaggagggatgggcacctggaaccacagggcggcgctgatgattggaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagag

SEQ ID NO: 176877 - DNA, 5992 bp, Homo sapiens
  Payload ID: 14710
  Gene Symbol: RPS6KA2
  Gene Name: ribosomal protein S6 kinase, 90kDa, polypeptide 2
  ENST ID: ENST00000510118
  CDS Start-End: 342-2618
gcagtacagattccgaagccgcagcgccgtcccctcctttcctcgccccagcccgagcgggaagcggcagcagctccccagagccctggcttggcagggaggggacggcgcccgagcagccatattgcagccccccgggtccctcctccggccggcgcaggccccgcgctcacgacctcctctgggagccggatctgtcctctccatcgccgccacccgccggcctctgcgtcccttggcttccgacatcccgtctggccgtccccctgtgccggtccgagcctctgtttatttcctttcctactatcaatactcgaccagcagaaaaggaaagtttaaaaatgccaatcgcacagttgctggaactatggaaaaagatcgaggtggagcctatggaaatagagaccacagaggaggatctcaacctggatgtggagcccaccacagaagacactgcagaagaaggcaaaagtgactcagctgcctgcaagacaaaggtagctggatccgtagaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgcccgccctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaactaaaaaaaaaaaaataaagaaaaaatgtgctgcgttctgaaaaataactccttagcttggtctgattgttttcagaccttaaaatataaacttgtttcacaagctttaatccatgtggattttttttttcttagagaaccacaaaacataaaaggagcaagtcggactgaatacctgtttccatagtgcccacagggtattcctcacattttctccatagaagatgctttttcccaaggctagaacgacttccaccatgatgaatttgctttttaggtcttaattatttcacttctttttagaaacttaggaagaagtggataatcctgaggtcacacaatctgtcctcccagaaatgaacaaaagtcatcaccttttctgcttgctacacaggcaacgattcccccatcagctgcccggaccctttggcctggcttggtgtgcaggcctgtctgtttgcttaaagtcagtgggttctggtgcagggagtgagaagtgggggaagtgaaagggaaagcatccgtgagaaagcggccacggttttccctccttgtgtgcccatggggcaccagctcatggtctttttcagtcatcccagtttgtacagacttagcttctgaactctaagaatgccaaagggaccgacgagactccccatcacagcgagctctgtccttacatgtatttgatgtgcatcagcggaggagaacactggcttggccctgctccgctgagtgtctgtgaaatacctctactttccctcccatatccagaacaaaatgatacttgacatccttccacaaaagtcagcctaaagaagttatggtatcatatgttaaactaagctttcaaaaaccttagtgaaatagcaagtgactgctttcaagcagcagtcgacatgtaaatgaaggtgttcttagaattcgcattttgccagctcagcgcacctccacaacgaatgaaatgctccgtatgatttgcacaaatgacatagacctccccaaaagttaactggctctccttcctcacacagttcatcataacccaaccccccacccccgggtcatgaaaatcacagaacttataaacacattgaaccctagatctcaggcttcctgacctaccgccagtggccccttgctggccaccctatagggtcctccttccctggcagccccccatgtgggagaaatacctgattctcccaatctgcagtgggagagctttgctgaattccatcccaaagtcaaacatgggcaagaggtgaggatttcacttttaccctcaagtccgatttgtctgtgattttaaactaactgtgtatgtattgatgtttggaagattgtttgaattttaaagtgataatagtacttaatgttatccagtattgttcattaaatggtgttatcctaaagctgcacttgggatttttacctaacgctttactgattctctcaagcacatggcaaagtttgatttgcactccgttcatttctgacacgttttgctgcctcctacctttctaagcgtcatgcaaattcgagaatggagaaggacgctgccggtccctgagcggtgtggagagggcggaaggtggactccagcgcagcttgaggggctgaggacggaggctgcagcatctgtgtcgttctactgagcacgcttctctgcctcgctcctgactcagcactttgttcactggctcagcagttatgtttacacatcatttttatgttcctgctttgtaattcatgtttgagatgggtggccactgtacagatatttattacgctttccagactttctgaatagatttttttgaataaacatggttttatgaagtgt

SEQ ID NO: 176878 - DNA, 2297 bp, Homo sapiens
  Payload ID: 14710
  Gene Symbol: RPS6KA2
  Gene Name: ribosomal protein S6 kinase, 90kDa, polypeptide 2
  ENST ID: ENST00000481261
  CDS Start-End: 260-2194
aaacgtcctaggccctggttggaatggaagcagctttgccaggagcatgggtcctgggcctcagatgatctgaattctcgtcccttgaatagaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagca

SEQ ID NO: 176879 - DNA, 759 bp, Homo sapiens
  Payload ID: 14710
  Gene Symbol: RPS6KA2
  Gene Name: ribosomal protein S6 kinase, 90kDa, polypeptide 2
  ENST ID: ENST00000507371
  CDS Start-End: 335-759
acttcgcattctcatcagaggagaaggccagcctcggggctgaggttttctcagcttctctcctttgcttctgagtttgcaaagcgggggttttgtctgcagccagagttttttcaactcacagctggtgcctgtgaggggcaggactcccggcttgggaatctgtggctgcctggagaggggtgaggggagggaagaggaggtgtgcggggtggctgcctggtgacgaggacgggcgcagcagcccacaaggtgataaaaggagtggcggctgccctggcagaatggctggacggcaaggggagcccggcccccgggacctggggagtgcatcatgatgatcaggctgccacacaagaagctgcagagactgttcctcagaaaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacgga

SEQ ID NO: 176880 - DNA, 587 bp, Homo sapiens
  Payload ID: 14710
  Gene Symbol: RPS6KA2
  Gene Name: ribosomal protein S6 kinase, 90kDa, polypeptide 2
  ENST ID: ENST00000506565
  CDS Start-End: 74-587
atggcagcggcatcctcagactcaactttcaccctcgtttagagccaattaagcagaaaaggaaagtttaaaaatgccaatcgcacagttgctggaactatggaaaaagatcgaggtggagcctatggaaatagagaccacagaggaggatctcaacctggatgtggagcccaccacagaagacactgcagaagaaggcaaaagtgactcagctgcctgcaagacaaaggtagctggatccgtagaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctct

SEQ ID NO: 176881 - DNA, 614 bp, Homo sapiens
  Payload ID: 14710
  Gene Symbol: RPS6KA2
  Gene Name: ribosomal protein S6 kinase, 90kDa, polypeptide 2
  ENST ID: ENST00000511034
  CDS Start-End: 506-614
gtccgctccggcggagggaaggcgccggttccgcggagggcggctcctggccgagctgcagggcccgctggcaggcggcggtccctcgctcgctgtgccgctgaggttttggctgcgtttgctgatcaacaattaaagtttggttcggcagagaaaaacatgatgacaaagtgtgcatagggatgttttaaggaaggaaaacataatgacggccccaagctggaagaaagagcagccgggccgaagttgcgtgacaggaacgcccgcgactgcgcggctccggagcagctgcacaactcgcccgggccgggagctgtcccgggccgaggctcattaggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcatt

SEQ ID NO: 176882 - DNA, 4137 bp, Homo sapiens
  Payload ID: 14710
  Gene Symbol: RPS6KA2
  Gene Name: ribosomal protein S6 kinase, 90kDa, polypeptide 2
  Uniprot ID: Q15349
  ENST ID: ENST00000503859
  CDS Start-End: 382-2607
aattcgaagctgcaagtgcagcgtttactctgccaaagtcgcagtacagattccgaagccgcagcgccgtcccctcctttcctcgccccagcccgagcgggaagcggcagcagctccccagagccctggcttggcagggaggggacggcgcccgagcagccatattgcagccccccgggtccctcctccggccggcgcaggccccgcgctcacgacctcctctgggagccggatctgtcctctccatcgccgccacccgccggcctctgcgtcccttggcttccgacatcccgtctggccgtccccctgtgccggtccgagcctctgtttatttcctttcctactatcaatactcgaccagcagaaaaggaaagtttaaaaatgccaatcgcacagttgctggaactatggaaaaagatcgaggtggagcctatggaaatagagaccacagaggaggatctcaacctggatgtggagcccaccacagaagacactgcagaagaagaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaagcctgagaacatcctcctggatgaagaggggcacattaagatcacagatttcggcctgagtaaggaggccattgaccacgacaagagagcgtactccttctgcgggacgatcgagtacatggcgcccgaggtggtgaaccggcgaggacacacgcagagtgccgactggtggtccttcggcgtgctcatgtttgagatgctcacggggtccctgccgttccaggggaaggacaggaaggagaccatggctctcatcctcaaagccaagctggggatgccgcagttcctcagtggggaggcacagagtttgctgcgagctctcttcaaacggaacccctgcaaccggctgggtgctggcattgacggagtggaggaaattaagcgccatcccttctttgtgaccatagactggaacacgctgtaccggaaggagatcaagccaccgttcaaaccagcagtgggcaggcctgaggacaccttccactttgaccccgagttcacagcgcggacgcccacagactctcctggcgtccccccgagtgcaaacgctcatcacctgtttagaggattcagctttgtggcctcaagcctgatccaggagccctcacagcaagatctgcacaaagtcccagttcacccaatcgtgcagcagttacacgggaacaacatccacttcaccgatggctacgagatcaaggaggacatcggggtgggctcctactcagtgtgcaagcgatgtgtgcataaagccacagacaccgagtatgccgtgaagatcattgataagagcaagagagacccctcggaagagattgagatcctcctgcggtacggccagcacccgaacatcatcaccctcaaggatgtctatgatgatggcaagtttgtgtacctggtaatggagctgatgcgtggtggggagctcctggaccgcatcctccggcagagatacttctcggagcgcgaagccagtgacgtcctgtgcaccatcaccaagaccatggactacctccattcccagggggttgttcatcgagacctgaagccgagtaacatcctgtacagggatgagtcggggagcccagaatccatccgagtctgcgacttcggctttgccaagcagctgcgcgcggggaacgggctgctcatgacaccctgctacacggccaatttcgtggccccggaggtcctgaagcgtcaaggctatgatgcggcgtgtgacatctggagtttggggatcctgttgtacaccatgctggcaggatttaccccttttgcaaatgggccagacgatacccctgaggagattctggcgcggatcggcagtgggaagtatgccctttctgggggaaactgggactcgatatctgacgcagctaaagacgtcgtgtccaagatgctccacgtggaccctcatcagcgcctgacggcgatgcaagtgctcaaacacccgtgggtggtcaacagagagtacctgtccccaaaccagctcagccgacaggacgtgcacctggtgaagggcgcgatggccgccacctactttgctctaaacagaacacctcaggccccgcggctggagcccgtgctgtcatccaacctggctcagcgcagaggcatgaagagactcacgtccacgcggctgtagcgggtgggaccctggccccagcgtcccctgccagcatcctcgtgggctcacagaccccggcctcggagcccgtctggcacccagagtgaccacaagtccagcagggaggcggcgcccgccctcgccgtgtccgtgttttctttttcagccccggagagggtcctgacctgggggcttctccaagcctcactgcgccagcctccccgcccgctctcttttctcccaagcgaaaccaaatgcgccccttcacctcgcgtgcccgtgcgaggccgggggcttctttcagagcccgcgggtcctctcatacatggcttctgtttctgccgagagatctgttttccaattatgaagccggtcggtttggtcagactcccgacacccacgtcccaggtacccggtgggaaagtggcagtgcgagggcgcagccattggtggttgcagggccccagagggctggggtgacctggcatcccggggctccccacgggctggatgacggggttggcactgtggcgtccaggaggagatgcctggttctgcccaaaataatccaaagagccgtttcctcctcgcccttcagtttttgcctgaggtgctgggtagcccatcctttcctctgtcccagattcaaatgaggagtaagagcccagacgagaggaaggcaggctggatctttgccttgagagctccgtgtcaccaggatggaagggggtgcctctcggaggagcctgtgtccacctccagtctcggctttccccggggggccaagcgcactgggctgccgtctgtccccagctcccgtggccacacagctatctggaggctttgcagggagtcgtgggttctcgcacctgctcagccctgtgtcggcttcctgtgtgctcacctaaagctgtggttttgctgtgttcacttcgatttttctggtctgtggagaaactgtgaattggagaaatggagctctgtggcttcccacccaaaccttctcagtccagctggaggctggagggagacacaggccccacccagcagactgaggggcagaggcacaggtgggagggcagcggagatcagcgtggacaggagcgatgcactttgtagatgctgtggctttgtgttgcgttttgtgtctctgttgcacagatctgttttttcacactgatccgtattcccctgggtgtgcacacagggcgggtgtggggcatttaggccatgctgtgctctacttcattgagtaaaatcgagtgagaggttccgggcagcaggatcgacgcccagtccagccggcagagggaacacacgggtccttcattgtcctgtaagggtgttgaagatgctccctggcggcccccaagcagactagatgggaggaggcgccgctcagcccctcaccctgcatcactgaagagcggcgcctctgcagcaagcagggcttcaggaggtgcccgctggccacagccaggttttccctaagaagatgttattttgttgggttttgttccccctccatctcgattctcgtacccaact

SEQ ID NO: 176883 - DNA, 552 bp, Homo sapiens
  Payload ID: 14710
  Gene Symbol: RPS6KA2
  Gene Name: ribosomal protein S6 kinase, 90kDa, polypeptide 2
  ENST ID: ENST00000512860
  CDS Start-End: 263-552
agagaccctgggagtcctagctggttcctggatggaaattctttgaccagcgtcctatatggcctaaagggaaaagtacaggagctctggaggggaagaaggcgtcgtgaaggagatagacatcagccatcatgtgaaggagggctttgagaaggcagatccttcccagtttgagctgctgaaggttttaggacaaggatcctatggaaaggtgttcctggtgaggaaggtgaaggggtccgacgctgggcagctctacgccatgaaggtccttaagaaagccaccctaaaagttcgggaccgagtgagatcgaagatggagagagacatcttggcagaagtgaatcaccccttcattgtgaagcttcattatgcctttcagacggaaggaaagctctacctgatcctggacttcctgcggggaggggacctcttcacccggctctccaaagaggtcatgttcacggaggaggatgtcaagttctacctggctgagctggccttggctttagaccatctccacagcctggggatcatctacagagatctgaa

SEQ ID NO: 176884 - DNA, 7918 bp, Homo sapiens
  Payload ID: 14711
  Gene Symbol: RPS6KA3
  Gene Name: ribosomal protein S6 kinase, 90kDa, polypeptide 3
  Uniprot ID: P51812
  ENST ID: ENST00000379565
  CDS Start-End: 209-2431
aggcgcgcggctttcgggcggtcggcgtcggcgtcgagccctctctggggccgccgccgctgctgctgctgctgccgctgccgctgccgctgccgccgccgccgccgccgccgccgctgccgtggggctcgggcggcgacggagcggggccggccgtggggcgggcggggagggaggaggcggtgaaggcggcgggccgggggggaagatgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaaggaaaaaaaaaaaaaagaatgtactcatacagatttttgttagtcatcatgtaataagccatttatatcagaaaccttttttcctgccacagaagctttaaattttcccctaagagtacaaagccaagagagtgtggtttatctaaatgtcctgaaatccacttgtcattccttaatttctcctctatgcaattaaagagaaaggggaaatctataacatttcttttgcccaagtgacacaaaaatgattactgcatagaaatcaaatgtaagtttagcttctaaatgaaataatatataggagggatatcagaatgtctagatagagaaagtattttcaaattcttgaatatatggatgctattaaaagctgctttccattgcctggaaagagagcttttttccctcctctattcagtgtttcaaactttggtcatctcaaattattgtcacttttaaaatgttaatgtcattctgagcagaaatagatatattttcagatttttttacactgatgctactccgtaattgcttaggagtattgtccatcatagtattttagaactagaagtaaacacataaatccttataaattacccaatccaactttctcatattgcatgtagagaacctgagacacatatcaaagtctagaatccttaacttctccccattttgtttttttccgcctcatcacaccatgctgcctttccctcatatgatcaccaaccagtagctgagttcaaaaactacatatttcttgggcagtcctctactggtatgtgatgccaacttttatttctttcgaagataattgccttctttgcctagccaagcagccaattttattggagaaaagcaagttatatgttcacaaaatggaaggctttctacctaaatttatttcatctgtggtcctcttattctcttccattgcttttgacatacagtggaaaaacttggccaacgatgtgctctaaatatagtgcttgtgttgggttaacttttccattaatttctcaacatcaattattcaggcccctacagttgtggtattgaggcccctaaaggcttctgcctttcaccaattagtgctgccagttactgaggcttctcccaaaaggtatcagtccagtcttaaagatatttcattgtgaaagaagaaactaaactatcaggcctcttttacaaaatgagagattgaatttaagcttgtcaagcacgtactggaaggtatgaattacactaccatgtgttttgtatcttccctttcaagtgatgatgttaaatgaaggtaagtttttcatccttttttaatttttgttttttataaatcatttcagctttttctggtttatagaggtgtcttatttctaatgcaacagacccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaatattgcttgtattcctgtcatagaacaggttttgtaatctttaaaagaaatgaaaatttatataataaagtttcaaatcaatgca

SEQ ID NO: 176885 - DNA, 530 bp, Homo sapiens
  Payload ID: 14711
  Gene Symbol: RPS6KA3
  Gene Name: ribosomal protein S6 kinase, 90kDa, polypeptide 3
  ENST ID: ENST00000438357
  CDS Start-End: 132-530
gggggggaagatgccgctggcgcagctggcggacccgtggcagaagatggctgtggagagcccgtccgacagcgctgaggataaatgaggagctgattcttaatcctgtcacattgaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaa

SEQ ID NO: 176886 - DNA, 804 bp, Homo sapiens
  Payload ID: 14711
  Gene Symbol: RPS6KA3
  Gene Name: ribosomal protein S6 kinase, 90kDa, polypeptide 3
  ENST ID: ENST00000457145
  CDS Start-End: 122-804
aggaaattttctaattgccggaacagctggtaggagaaaactttgcaggggcttggccttccctttctaacttaagttttaccgtcagaaattcttttatcaccatcatggtttcgtagccatgtttaaatttttgtcttttcgtgttcgctctatacaggaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgtt

SEQ ID NO: 176887 - DNA, 3119 bp, Homo sapiens
  Payload ID: 14712
  Gene Symbol: RPS6KA4
  Gene Name: ribosomal protein S6 kinase, 90kDa, polypeptide 4
  Uniprot ID: O75676
  ENST ID: ENST00000334205
  CDS Start-End: 66-2384
ggagccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaagagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 176888 - DNA, 2114 bp, Homo sapiens
  Payload ID: 14712
  Gene Symbol: RPS6KA4
  Gene Name: ribosomal protein S6 kinase, 90kDa, polypeptide 4
  ENST ID: ENST00000530504
  CDS Start-End: 1-2114
acagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaagagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccct

SEQ ID NO: 176889 - DNA, 2532 bp, Homo sapiens
  Payload ID: 14712
  Gene Symbol: RPS6KA4
  Gene Name: ribosomal protein S6 kinase, 90kDa, polypeptide 4
  ENST ID: ENST00000528355
  CDS Start-End: 55-201
gtaaccggcgccgcccggagcccgagccgcgcgggccccagcgacccgcccgccatgggggacgaggacgacgatgagagctgcgccgtggagctgcggatcacagaagccaacctgaccgggcacgaggagaagcctacggcaaggtgttcctggtgcggaaggcgggcgggcacgacgcggggaagctgtacgccatgaaggtgctgcgcaaggcggcgctggtgcagcgcgccaagacgcaagagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaaggggg

SEQ ID NO: 176890 - DNA, 3121 bp, Homo sapiens
  Payload ID: 14712
  Gene Symbol: RPS6KA4
  Gene Name: ribosomal protein S6 kinase, 90kDa, polypeptide 4
  ENST ID: ENST00000528057
  CDS Start-End: 89-2386
accaggaagcgcccgccccggccggagccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaagagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 176891 - DNA, 3807 bp, Homo sapiens
  Payload ID: 14713
  Gene Symbol: RPS6KA5
  Gene Name: ribosomal protein S6 kinase, 90kDa, polypeptide 5
  ENST ID: ENST00000261991
  CDS Start-End: 161-2584
cgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgaggcattaagaaaaaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcagttccagtgagagttcccattcttcttcctctcattctcacggtaaaactacacccaccaagacactgcagcccagcaatcctgccgacagcaataacccggagaccctcttccagttctcggactcacttaggcatggtaggagttatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtgaaaaaaaaaaaaaaagatataagaactcaaggtcccatactctgtattcgggatccatctgagatgcatgctaagctatgtgtatgtttttaattttgcactgctctttcctggcaatttgttttaatggttattgcagaatattaaggtacatgtctctctgttttaagtaatattgcactttataaaaaagtatgaataaagcaaactattttataaagtgcactgtttaaagcatttgcactgtatttttgccatttattttcattttctactttaaatttgtcctcacattcctcttctactttgtatgcaacaagtagaatggggcatgttgtgtcatgtagtcagccacttatgcaccaatgtgaggaaaacctaaagggaaattaaactaaacactgtgcttcatatttgtacactgtgttgtactacagtgaggaatttcctcctgtagtcatatattatgtacataatattttagaatcatacctatgacttgtttggaaatttttctgttaaattttaaatccagaaagcatattttataaacttatgcagagcacttttattgctcaaaagttctgaattcatacagaaaacaagtactatgtgatgaaaacatttcattaaaagattgctgcatttaaaaatacaattaattcgttccctatgc

SEQ ID NO: 176892 - DNA, 2249 bp, Homo sapiens
  Payload ID: 14713
  Gene Symbol: RPS6KA5
  Gene Name: ribosomal protein S6 kinase, 90kDa, polypeptide 5
  Uniprot ID: O75582
  ENST ID: ENST00000418736
  CDS Start-End: 167-1816
gcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgaggtataaaatcactggatctcttacgtaattcagtctagcaccattattaaagatctcccaaacatgggggaagtttctggggaggtttccttatttttttacttttcaaggctgttaaatagataattgaaaatacgtttctttgatgttttttcttttatatttcagtctaaaataaatttgtctttgtttattttttgccagctgatcatcttgaggttatatttgtaagtgtgagaaccttttatggaaaaaatactttatgcaacagttgtggactaaaaatagcaatggaaatttttatagcagaaaataatatctcttacatataattttagagggttttttttccaaatgatgtattttgaaaacttattttttacatttgtaatcaaattggttagctcatgaataaaaatgtatataattctattctaaa

SEQ ID NO: 176893 - DNA, 2993 bp, Homo sapiens
  Payload ID: 14713
  Gene Symbol: RPS6KA5
  Gene Name: ribosomal protein S6 kinase, 90kDa, polypeptide 5
  Uniprot ID: O75582
  ENST ID: ENST00000536315
  CDS Start-End: 252-2423
agttttccccagcccgggaatgagcggcgggcaccaggcatcggggccagcgcagccgccgaccgctgcccgtggcacgcacctccgaggatgtcgctgctcccccttcccgcacagctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcagttccagtgagagttcccattcttcttcctctcattctcacggtaaaactacacccaccaagacactgcagcccagcaatcctgccgacagcaataacccggagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtg

SEQ ID NO: 176894 - DNA, 1420 bp, Homo sapiens
  Payload ID: 14713
  Gene Symbol: RPS6KA5
  Gene Name: ribosomal protein S6 kinase, 90kDa, polypeptide 5
  ENST ID: ENST00000554206
  CDS Start-End: 203-862
actagcggtgcccgccgaagggggaggaggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaacttgaaatcaaatcccttttttgtttgtttgttcaagactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctct

SEQ ID NO: 176895 - DNA, 2118 bp, Homo sapiens
  Payload ID: 14713
  Gene Symbol: RPS6KA5
  Gene Name: ribosomal protein S6 kinase, 90kDa, polypeptide 5
  ENST ID: ENST00000556178
  CDS Start-End: 1-239
cttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcagttccagtgagagttcccattcttcttcctctcattctcacggtaaaactacacccaccaagacactgcagcccagcaatcctgccgacagcaataacccggagaccctcttccagttctcggactcagtagcttag

SEQ ID NO: 176896 - DNA, 596 bp, Homo sapiens
  Payload ID: 14713
  Gene Symbol: RPS6KA5
  Gene Name: ribosomal protein S6 kinase, 90kDa, polypeptide 5
  ENST ID: ENST00000556594
  CDS Start-End: 152-403
agagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgagacgagtctactctgttgcccaggctggagtgtggtgctgatctcggctcactataacctccgcctcctgggttcaagtgattctcctgcctcagcctcccaagtggctgggattacaggcacccactaccatacccagctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacg

SEQ ID NO: 176897 - DNA, 26795 bp, Homo sapiens
  Payload ID: 14713
  Gene Symbol: RPS6KA5
  Gene Name: ribosomal protein S6 kinase, 90kDa, polypeptide 5
  Uniprot ID: O75582
  ENST ID: ENST00000614987
  CDS Start-End: 175-2583
ggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcagttccagtgagagttcccattcttcttcctctcattctcacggtaaaactacacccaccaagacactgcagcccagcaatcctgccgacagcaataacccggagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtgaaaaaaaaaaaaaaagatataagaactcaaggtcccatactctgtattcgggatccatctgagatgcatgctaagctatgtgtatgtttttaattttgcactgctctttcctggcaatttgttttaatggttattgcagaatattaaggtacatgtctctctgttttaagtaatattgcactttataaaaaagtatgaataaagcaaactattttataaagtgcactgtttaaagcatttgcactgtatttttgccatttattttcattttctactttaaatttgtcctcacattcctcttctactttgtatgcaacaagtagaatggggcatgttgtgtcatgtagtcagccacttatgcaccaatgtgaggaaaacctaaagggaaattaaactaaacactgtgcttcatatttgtacactgtgttgtactacagtgaggaatttcctcctgtagtcatatattatgtacataatattttagaatcatacctatgacttgtttggaaatttttctgttaaattttaaatccagaaagcatattttataaacttatgcagagcacttttattgctcaaaagttctgaattcatacagaaaacaagtactatgtgatgaaaacatttcattaaaagattgctgcatttaaaaatacaattaattcgttccctatgcaaaaaaaaaaaaaaaaaaaaaagaagtgatagggtttgtgtgttatattttcttttaaagccatcatgtgaaatgtcaggactgagaaaagtgatttttttgctttgtttacaggaatcatgcttaaagagataatgcccaacatgtttattttatagtttttgttaatgataaccttttgagcattagtttggaatttggacatgatatttatttattcctttcttgaggttatagcagcattaatttcaaccagttatgaatactaaaaatattgcactctatgtaatagtagtatatttattactaaatcaatgtatatattaatagcacaggcaaaaaatggcaaatattaaaatattttcaaaatattatattatcctgttcacattttgtccacagtggttattgggaataatattttacactttttgctggcccaaatggctacataatattgagttaatgaaagttttctactcccagctttcagttattcctagtaattatgggaaattttgtgtgaattattaccaaactattgctaattcacaaaatgtgattccatcaggcacagatctctagtaatcaagaaaatgaccatatttataattatattggacatattgggaacatatttggctcttcaagccattttttaaactgtgcatcctggtagaaaatactagttataaagtacaaactaaagggactatgttgctaatagaaaatgatccagaaaaatggtcagacagtatacagattgatgatgtgattgatttcattgtgaatattggaaattaatgggtttcattttcatttatttcccttgcctcttcttgaggaggattcgacaggcgatgaaatgggtaaaaaggcagtcagactaacaggaagaaggaaagataggctagctgtcaactgatgagcctgcctgaataatctcaaatgggcttttgaaaagaccttaacaaacactgttgcactcttgtcaaatatctttatctacaccctacttataagtaccaaaaagacagcatttgatgccaagtttgaagcagttaggtcctatgcaggctgtgtattaacatacagtgaattgcactttaaaattcagaaagctttcatttggtcacatcaaaaataaacactacaaaatatataaaaagttaaatgataggactctttttttggtattaagagtaaaatagaagaagatctaagaaatacaaatacttacattatttctccttatgacattaactttgggactagagccacaccaccccctcccttcttcacttactgattgtattgcatataattttcatgccaacataaatcctgattcatatattttgtaactgtatatgacaaattgagaggcaagaataagaaaaggaagataatagaggaaagatgttaagaaagaccagtttcttctaattactctgccagatcgtgtgtctgaaagaggttaattagcattttgaaattgattggctgagtgtggtggctcaggcctgtaatccttgtgctttgggagtataagactggagaatcacttgaaaccaggagttagagaccaacctgggcaacatagtgagacactgtctctccaaaaataaaaataaaaattagctgagcatggtggctcatgggaggccaacatgtggaggatcgcttgagcccaggagttcgaggctgcagtgagctgtgatcacaccactgcactccagcctgggcaacagagcgagaccctgtcttaagaaaaaaagaaattcattaattcttccaaacctttataaagtaagaaaccactgaattactagaatagaaagtcagtctcctgagttaatttccacattgttgtctgtcttggagtcacaggttcattacccaagaaaactgccttttaatttttttagattactgttgatttcttaagtatgtaaatgactaacttttaaatataaggtaagttattttaaagaaatctactaagatagaagtcactttttttaaagtaaggaaattccttttgtatctcagtttatgttctcaaatacactactttataaaagtatacaattgactggatacttattcaccttgcccccatttcaagcgcctgttattgtcatatttattaaaaacagggtacctcataatggtgaaaatttctaaattattgggtctatatgtgccttagactgcctgattactttggctgttctcccagtgactgataataatagcatgatttgagtgttcatgtgagaatacatctaatattccttaagatctaagtaaataagttaaattctgatatgccacttatgtcaaaataattgttatatagatgaattattactgtaacatcatgaagtatcttaaaattatatgacttttggcctctcaaatgtcttacatgataataccccaatttccagtctttaattgattgtatacctcacgtaagtgtctgtcatcacttgatacctgtatctggcactaaaacaaatgtagccggctctaatgaaatttgaagtttggataggagacattgtaaaactcaagaatgggaaaaaaaaattttaacagaagtatgtatgaaggaaatattttaagtataatctacccaaagaaaataactgctacagccaacattaaaggttttattccctgttttgttaagtaacttcactccaaattgtgacattctttagagaaaatattttccttaagagtagttatttacgtgttttattgggggagcatattttcaggggggcaacatcttgctaagaacatttgattagcctcacttctgtcctcaccttctatattgcttacttttcaagatatttcttctgagcccttttctttgtatgcccagctccctgttatgtaattaagtagttgattaccattccaaatgcttcccctacacaaggctgttgtccaccctgtttcatgaatttgtgaattaagtaggtgcctaatattttcctactattagggtgaaaaggaataagaaactaaagtggcttccaaatgtttgtgtcttggtttcttcaccctagtgcaaaataggaaatgtttattggcagtcatttcttttccattactccttttaaccacattacaaaaagctaggattttgtgtctagaaggagacttgtattaaaagacaagattcttagtagttattcatcaggcttaagtttcctggtgtatttcttgtgggagaggtagaaggacattttgtagtagtattctaactattaatataatgctgcttgggttatcagaaagtattgaatacttcagataagtcaagttagtatttagtatagcagctgttcttcagagcacaggaaactgggatagtatgtagtattatgctgtttccattattgtttctcattgcataacacttttaatttatatgttggtatacaatttgcccctttactaaaaaaaaaaatctagtttcattcttgttccttgccacattaagcagttttttcatttacgttttaaattttcttaatattagaagaaaaagaaaacagaacaaaagagaaatgtcatgacttagaaaaggaaattttaagttttatggaatactgtagctttattttctgacatttctgcttatagatagattagaaaatccttgtttcttttgtttgctttgttttaaaatccagtaaggttgaggaacttgacattttaaaactgcagttttatttttaactacataagaggctggtcatgtgaaatgtgcactgctatgttggaatggatatgtatgtgacaattaacctcattaaagctctgttgctgtggtaggcattcagttattcctaatagtttattttaggtactatactgctatcctatttgctgaaattataaatactagcaatgtacaataattctcattctttggctgaataaaaacagaaatttaaaggtgctgtgtcacataaacagttaatgcctcagtactaaagttttgaaaaatattcctaaaaacttcacaggcatgaatttttgaaaagaagaagaaaccacatatacacatagaggaatttttaaagactggcattttaaagtatagctggtaaaaatggtatgtatccttatgtgtagaatttaaacttcttgaaaataatctaagctgcaacaatctatgtaactgctcttccacagttttacataaagataagaatttgtcttactaaaaggtaaatggaagattaaaaaagatgaaaaacattgtttttcctctattctatgtggacaattaaaagtatagccaagcctcagctcaaatgagttgcctttgtgtgagacagggtctcactctgtcaccctggccggagtgcagtggcgtgatcacagctcactgcaacctccacctcctgggctcaagcaatccttgtacctcagcctcctaagcagctgactaagtagactacaggcatgagccaccatgcccagctaatttttttttaatagctacaaggtatcagtatggtgcccaggctagtctcaaactcctggcttcaagcaatcctcccgcctcagcctcccagctttgcccagccgtgagttgctttgtgagttgtcttccttaactgcatcagttcatcccatactccgtacatgcactttttctcgtatttttctgcttttctatggtgtgtccacactcatttgtgtatttctacactggtatttcactacttattaagatatctgcatgtggacctacatttataaattgtaattccgttcagagaaataagaacttgattgggacagagctgggaaatgtttgtgatgaaaattattaggaataaggaaataatgatgctgtgtgagaaagcaagtagacttaaattctgagatagaaacatctgcaatcaacatagagaaggctactttacaaaaatgttatttcagtgcccgtatggacaaatctctttaaaaggctttgtctactgtgtacataaaggaacttataagcttcataaagtgcttatttttctctaggaagcccatgtgatagctctctcctctgttttcccactccttccccagcttttcctgctgcccactgctccaaacactgacatccagtggccagagaccagtccaaatggagcactaaaactacatatagatagtgatcatattgtttaaaatgttattgcaacatggtgtgtaaagtgcacaggtctgaaatatacagctcaataaatgtttacatatatatgcgcccatataaccatcattcagatcaagatgaggctcccagtcagtcctcatacataaccaccactctgacctctgtcactgttgttgacattcctatacatggaattatccagtctataggtttttgtgtctggtttaatttgatcagcattatgtctgtgaaatgcatctatgttgttgcatgtagcaataacagtagtttgttctttttcgttgctctgtagtattccatcagataaatacatcacaatttatccattctcccactgatagacattttggttgtttgtaatttttagcttttgtgtttaaagcagccataagcattcttgtgcatatattttaatggacacgtacactcatttctcttgtgtgtccacttaaaagtgaaacagctggctgcagtgagccttgatcgcaccactacattccatcctgggcgatagagtgagaccctgtctcaaaaaaacagacaaaaaaaaggagtgaaactactgagtcataagatgaatatatatttagctgtagaagatattaccaaatggttttcaacaatggttgtaccaatttacatacccaccaataatgtgtaagtgttctagttcttccacatcctcatcagtgcttggtaccatcagccctagtagtttagccactctgacaaatgtgtatatttgattgtggttttaaccattctggtgattttgtatttcactgagattttaaggtgtattttcctgataagtagtgatgtgtggaacacctttttatatttttattagtcatttggctatcctcaattaagtgcctgttcaagtcatttgttcatatttattgggttgtctttttttcttactgacttgcaggagtcttttatattttatggatatgagggtttttgtctgatattttaccataaatgtcttctctttagtttgcttttctactttctaagtgctttcctttgatgaccaaaaattttatgaagtccaatataccagtcttttatttaattgctaatacttttgcgtcgtatttaataaatgttcacaccaaggttatgaagatattcttatattcttctaaaagctttattggccgggtgaggtggctcatgcctgtaatcctagtgctttgggaggccaagccaggtggatcactggaggtcaggagttggagaccagcctggccaacatggtgaaaccccatctctactaaaagtataaaaattagccaggcatggtggtgcatgcctgtaatcccagctacgtgggaggctgaggcaggagaatcgcttgaacccaggaggcagaggttgcagtgagccaaggtcatgccactacactctagcctaggcaacagagcgagactctgtctcaaaaaataaaactaaaagctttattgttttaccatccacattaggtttacagtccatctactgctgatatttgtatatgatgtgaaatagtagccaaagtttatgtatttccatatgagtattaacttgacccagcacaatgtattgaaaagctgagttgtaatttttatgaagtcttcatatctggtagtgtaagacctctaacttttatctaatagttctaatagttttggctattcttaatcctttgcatttccatatacattttagaatcaccttgttagttttgggggcagaggatgttagggtttaattggtattgcattgaatgtataaatcaatttcaggagaaattatatcttaccaattttgagttttccaatgcatggacatggtatatccctctatttacttaggtatttaatttgtctcaccagtgttttatagatttacatgtagaggttagatttatatctaggtttttgacagttttactttattatcaaattgtttttaattagtttatagaaatatagtttttttggtatattaccctttcacttagaaaccttgttaaattcactttttaattctaatctgtatattattttagatttctttaagtctacagttatatcgtctgtaaataatgacagtttcatttctgccttttcaatttttatttttcttgccttattgagctgatcaggacctccaataacatgctaaatgaagtaatgacaatggactccttaaacttcttcaactcagaataagaattcaatatttttctattctatatatatatatttttttcttttcttttcttttttttttttttttttttttttttttgagacggagtctcgctctgccacccaggctggagtgcagtggctcaatctcagctcactgcaacctccacctcccaggttcaagtgattcttctgcctcagtctcccgggtggctgggaccacaggcatgcaccaccaccctcagctaatttttgtattattagtagagatggggtttcaccatattggccagactggcctcgaattcctgacctcgtgatccacccgcctcagcctcccaaagtgctgagattacaggcatgagccacctcacccagcccaatattatgttttatttaatttttttatagatatcatatagcagattgttttatttctaattttcagagagtttttactaaatgctttttctgcctctgttgagataatcttgtatttttcttctttattcttcaattttcaaatgctgaaaatagaataaattccattttcatgatgtattgcccttttcatatatcaatggatatagtttgctaatattttgcctaagatttttggatcataaggaggatagacctagactgggtgtggtatctcacacctgtaatcccaacactttgggaggccaagaggaaggattgctttagcccaggagttggagaccagcctgggcaacatagagagacctcatctctacaaaagattaattagccaaggatggtggtgcacacctgtagtaccaaatacctgggaggctgaggtgggagaatcacttgagtccaggaagcagaagttgcagtgaaccaagattgtaccactgtactcccacctgggcaacagagcaggagcctagcattaaaaaaagaagaagaagaagaagaagaaggaggaggaggaggaggaggaggaagaagaaggacagacctgtaatttttctgtctttaatatttttgtcaagttttggtatcaagattattctggcctcataaaaaaaaagttggagatgtgttccctttttttctacactctggaagagtttgcacctgatattattcctcctgtttaaaataattcaccattgaagccacttgaatgagaagttttctttgtgggaaagttgtcattaattggaatatatcttgtctacttacagttaatgtaattattattggttttaagtctaccatcttacaatttcttttacatttttgtcctatatcctcttggttcctgtattgtgtcttcttttgataaaccaaatattttcttttgtccattgtttcctcctatgttagttcgttagtaatttttagaaattcatttagtaccttaaagattacagcttgtatctttgacttgctgccttaaattggtacattaccacttcccaacaatgcaggaattttatgacagtttaaatctgttttccccttttttttttttttttttgagatggagtctttgtcgccaggctgcagtgcagtggcacgatcttggctcactgcaacctctgattccctggttcaagcgattctcctgcctcagcctcccgagtagctgggattacagacacaagccagcacacccagctaatttttgtatttttagtagagacggggtttcaccatgttggccaggatggtctagatctcctgacctcgtgatctgcccacctcagcctcccaaagtgctgggattacaggtattcccccttcttccttttatgttattgttgtcatgtattttacttctacattctatgtatgttttatctctatatatgtgttttagacttcataagacattatttttttttttttgagacagagtctcgctctgtcgcccaggctggagtgcagtggcgggatctcggctcactgcaagctccgcctcccgggttcatgccattctcctgcctcagcctcccaagtagctggggctacaggcgcctgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggccgacattatttttattagtagtactactactatatattttaaagactctggctgggcactgtggctcacgcctgtaatcccagcactttgcgaggccaaggcaggtggatcacctgaggtcaggagttcgagaccagcctggctaacatggtgaaaccccgtttctactaaaaatacaaaaaatgagccaggagtggtagtgcatgcctgtaatcctagctacttgggaggctgaggcaggagaaacgcttgaacccggaagagggaggttgcagtgagccaaggtcgcaccattgcactccagattgggcaacaagagcgaaactccatctcaaaaaaaaaaaaaaaaaaatagactctatattgtttgtttgctcacatatttatgttttctggtgtttttctttccatcctgccttttttacttccatctgggattacttttcttcatctggagaattctctttagtatttattttagtgccagtcttctgacaatgaattctctcagcttttgttttttgaaaccttctttcttttgcctttatttttctgtatttttatttttttaagataaaattcatgtatcatgtaatatacccatctaatcattccattcagatacaattcaatgttacctttatttttgaaggatatttttgccttgtatgaaatactaggttcaccattttattttattttatttttgagaccaagtctcactctgtcacccaggctggagtgcagtggcacaatcttggctcactgcaacctccacctcctaggttcaagtgattcttgtgtctcagcctcccaggtagctgggattacaggcatgcaccaccacgcctggctaatttttgtgtttttagtagagatggggcttcaccacattagcgaggctggtctcaaactcctgacctcaagtgatctgcccacctcggcctcccaaagtgctgggattacaggtgtgagctactggcgcccagcctaggttcaccattttcaagatatcattccaatccttaagttctgtggaaaaagccattagttatatttcctttgaaggtaatgtgtcttttttctgtggtcacttttaagattttctcttcgtctttgtttttattttttattatacttttaagttctgggttacatgtgcagaacgtgcaggtttgttacataggtatacacgtgccctggtggtttgctgcacccatcaacctgtcaccaaattaggtatttctcctaatgttatccctcccctagcccccaaccccccgacaggccccagcgtgtgatgttcccctccctgtttccatgtgttctcattgttcaactcccacttatgagtgagaacatgcggtgtttagttttctgatcttttgatagtttgctgagaatgatggtttccagcttcatccatcctaagattggtaaacttcctgaatctgttggttgatgtccttccttattagaattcttaaccagtcattcttcaaatagttttttccaatccgttttctctctcccgttttctaggattgtgtgttatactatgttccatatgtctgttatagtcctttgtttgccatcttaatttctccctgtacttcaatctgtatagtttttactgacctaattaacttatcctgttctgctgagcctaatcaattttaaatttagttgtatatcttatattttggattctaaaatatccatgacacttttttgtaggtgccaagtctctgatcatatcttgtcttttcctctatattcttgaacacattaatcaaagtaattttaaaactcttgtctgagaaatccagtgtctgattactactactagttgtttgtttccattgtctgttgtcagtcatttggtgctgttttttagcatgccttataagtttggtgaaatgtcatacattgtgtgttaaatactgtaggggctttgaacgatgttatcttcctctaagatggttatgttttcttcttgcagtctgataaaatacaggcatatcactgtaatcctattgaaggttggttttagactttgttgggcttgtacatttcagttttgctcttactcctagcatatggcctctttgggctctcatctgaaaatctagggtgtttatcagggccacttcacctcggtgaccttgaattccaacctttccctcctcagtactaagagctgctcagctcgttagcctctcatctgctgctttttgctggatttcttgaagtctcaccttgttgcacaggagtctgcaattggcagacacctcaaggagatactgtaccagtatttcaggctcacttccctgaggtttcttcgctctgggattttgccccttaagtcctagctactttcccaagctccaacttttgtctcttcaaccaagtgggattactgcttgctgctaggtatttatttccctgtgttgtgaatttgcagtgccttgaagaagtaatcaaaatgaacacagagctcaccaaagtgtgcttcccttttttccctcctttcagctattttattgcagctcgtcaagttctccctgcattggtttgctccctgttgcctataaaagatgttctacttaacccttttcctgtttgccccaagaatacttgccagcagcacttgctgctgcagtatttaccccaagataactttgccacgaactctcgcttttattattactttcgtttagctctagtatattgacttcagaaaaaaaggacatcgttctctttatagcattctgttcttagtagtggtatttccatttacaaagtataataattctcgatcgctgaaaatgtcgaatcctagaaaatgtagcattcctacacgtgatgttaacatcattctcgaacagttcttggacagagatttatttaatgaattcgatttttctgaaatagatgattttgatgattcagatgcttctgatactagatctgtttagaaataacatcaagaacagtttttatattttattttcacattgaaaatcagtcagatttgctttagcctcaaagaatgtgtttacgtaaaattaaatgaatgctggcagtgagctgtactttttttttctaaaccggaaaagggttaatatagctttcatcgttgttttcagtaggagggctagtccaatcacaagctactctattgtggccaaaagcaaaaatctggtggtaatcatttttaatcgccattgttgatttctccgcagtggcttctggcattgataacttggttgtcacatggtcatatgtgaaggcacccggtttattcatttgttcctttgtccattaaatagtttttgagcacttctttcaggccaggtattactctagacacaagcaatataacaatatttaagataagatctgtgtcactttggcacttgcagcctgtttttatagaaaggctactaaatggttgccgagtcggacttgtggtaattaaaatagacttttcttgtgtgggggttgggagtgagaaaaaagagactggaatcttttagatgattacatcttctttatataaatatttttagccttttgaaaaaactctgtagagcttaatgcagttcacagttcacccacactacatcaatatttggcctaccttttgcaagcccaattccctaactatgagtttctgtgttacataaaaatctcaccgggagcacaattatttgacaatttgagttgaaactccaggaactgatttatggagaacaaacttagctctgaaattatgtctctttatgaatatcgacatgaaatctgatgaagaatcatcctactgtggtttcccattttaacttctgtttttgaaaaacatttcagatgcaactaagcacttattaaatgcttcgtgataccaaaaaatggcttggtggtctttgtcttccagaatagcataaatttcagtgttaccaagataaaaatataatctgggcacatgtcactgttaaaatattatagtcagatcaaggattctattcctgtctttgttattctttcccacttttgaaactttatccagtggatttttttttattacaaagacgtattccagagataacagtttgtacttctgattatgatccatgttcatgtgatcaaaaggcagcaataataggacactgtcatatatggtagctccatagaaactaggctgcactgggaggacagattcgccatcttgagcacctgtggcttggtattctcgaaattgtagcccctttggaatggctgaagaactaccagttaaaggtaaagaaaccagacacacaaggccacgtattgtatgattccacttacatgaaatgtccagaatgggcaaatccatagagacagaaagattagtgtttttcaggggctggtgggagggggaaatagggagtgacaatgtatacaggtgatggggttttggggtgatcaaaatgttctggaattaggtagtggtaatggttgcaagacattgtaaatgtagtaaaaaacaatgaatggtacacttaaaatgaattttatcttatattttaaaaaatcacacacaggccgtgcacagtggctcacgcctgtgatcccagcactttgggaggccgagacgggtggatcacctgaggtcaggagttggagaacagcctgaccaaaagggagaaactccatctctaataaaatacaaaaattagccgggcgtggtagcgcatgcctgtaatcccagctacttgagaggctgaggcaggagaatcactttaacccgggaggcagaggttgcagtgagcctagatcgcaccattgcactccagcctgggcaacaagagtgaaactccgtctcaaaaaaaaaaaaaaaaaaaatcacgcatagctagaaaggctgtagctagtttgaggaagtcagtactaacacctggctattcagagaatgccatcctgcccccctttctttggcatcaactctgaagcatagttatgttatggttggaaaatcttttctaactagagattaagctcttggggacaaagtaaacttgcctcttacaggaaacaccaaagttccagcttaacagagaaagggaacctccttgggaatcatacttttcccattattgggtagtgctcggacagatgtcaaagtgctgtatgtttccatggtgatcatatccagcttatcattacttgtatctttgccctaaagtttaatttcttactttgggactcattataataatgggagcaccggccttttgggaggccaaggcgggtggatcacgtgaggtcaggagtttgagagcagcctggccaacatggcgaaacgctgtctctactcacgcctgtaatcccagcactttgggaggctgaggcgggcggatcacgaggtcaggagatcgagaccatcctggctaacacggtgaaaccccgtctttactaaaaatacaaaaaattagccgggcgtggtggcggatgactgtagtcccagctgctcgggaggctgaggcagaagaatggcgtgaacctaggaggcagagcttgcagtgagccgagatcgcgccactgcactccagcctgggcaacagagcaagactctgtctcaaaaaaaaaaaaatacaaaaattagctgggcgtggtggtgggtgcctgtgggcccagctacttgggaggctgaggcaggatactctcttgaacccaggaagcagaggttgcagtgagccgagatcacgccattgcactccagcctaagcgacagagtgaaactccgtctcaaaaaaataaaaaataaaaaataatgtaagtaccaggcctttgtttgagttcagtttttctttggtgagcacttttctaaaatctctctcatcttacctatgttaactttgtctcagaagcaggctcatttgtgcagttagctgaaatatttattcagaaagtcatttatagcagttgtcttttcatcaaacataatacctttaaaatagcagaaaattaatgccattcatgattttgccattttactaagtagtcagaagctatgtctcccttagccccatcatatacatttgaaatatctttatcctagataatctgtattcatttgaatgcaaaagttttatcaatatgagtgaacttatacatctttttattcgctgatggagatatcacttgaaactttgttcctggcaaagcaaagagatgaaatgtattgaaaaaaatcgattagacttttaaaacttcaaaatacttttatagaaaatgtaaataagattgtttctaactgcagagtgttttacataaaatctttatgtgaagaatttatattgcagtacaataaagtcagtgctttttatatgttttgaatggtaaacattttgaaggtattttttgaagtaactaggtattgacattttttaataatatattttgaataaagcacacctaaaatgcatgaacttgtgtaagtatttggcatcattagtctagttgtacatatttttaaaaataagaatgggcttagaagataatgtatttgtagtaagtatagtatattttttactgagtgagtctgatacgtcttttagatatttgagtaaagtctactgttaaagtattccagatttttaaattccagtgtccttgctgtggaatctagtgttggctttctgatgtcagaataatcaaaccctgctcatatacacatccagaaaactttttctaatgatgatacatttagcaaaatcgcaagtctttaaaaattctagttaaatagacttacttgagacaagtgtacattgtgaaatctaaaataaaaatttgtgactatataatacataatcttcattatgtaggctatttctaaaaacttagtttctgtgctgatttcatgttaagtttttcaaacgttagcagattataatggctacagtaagttttgttctaaatctggtagccatttattattaaatgattaatgattaaacattaatcatttaataattacttaggaattataaattacaatgtcaaatcttcatacatcaggctccttgcactataattacttaaaattagtttgcatcaatagtctatataaacagatatcttagtttagaggaaaaaatattctattttctaggtactttaatagtttggtcttgtgaaaattacataggtgtgtgtttatgtatgtgtatacacacatgtattgggggcttacaataccaaattaataagactgcccctcactccttaaatcgactatctgccctgccagtaatcccccacctgtactggtatatacagagttttctctggtacaaatgattaatcaagaaaaagggtgtgaaatatttgtgttcgtttctttttaaatgaataatgggatacacataaactagtaacaccacattgatttcctaaagacctaatacagctttaagagggaataacattccagagctccaggattattttaatttagctttcaagatggttacgattttgatttaatatagagacttcatagtgttaaattttagggtttttttttttttttttgtatttttagtagagatggggtttcaccatgttggtcaggctggtctcgaactcctgccctgatgatctgcctgcctcggcctcccaaagtgctgggattacaggcgtgagccactgtgcccaacctaaattttaggtatttaaaacatccattgatgctttgttttgtttttgggttttttttttattgttgttacttaagggatgcatcttatttatttggttgacttttatctagacatcataaatgtgatgcttacttttttattagccacttcattgttgatgtcttaatgggagatcttagtttgatgaatctactctttgaaattttagtttgattagtcatttgtttctgctaggttttggcttttgttttgttttttgagtgataacctaagaagtttctacagtggaaaatatcattatgacatcttcatcccttataaagttgtttcatttagaggaatttttcaaagcctatgttgagaaatgggcaaattaagtaaagcatcataacaattttttttatagtgaactcattttatttatagaacggcaaacacattcactctttttgctaacatccggggcttttttcattgtgactgctttgcacacttaaaaatgtttctcccaggccgggcacggtggttcatgcctgtaatcccagcactttgggaggccgaggcgggcggatcacaaggtcaggagattgagaccatcctggctaacatggtgaaaccctgtctctactaaaaatacaacaaaaattagccgggcgtggtggcaggcgcctgtagtcccagctactggggaggctgagacaggagaatggcatgaacccgggaggcggagcttgtagtgagccgagatcgcgccactgcactccagcctgggcgacagagcaagactctgtctcaaaaaaaaaaaaaaaaaaaaagtttctcccagcaaaggctaactggaatttatttttgtttaaagacaaatacttttaatgtggataaaataaaagttggaagtatgcctttcatgtggcaaactggaaattagtggttagtactccattgcagcattaaataccaattctttacaatagggtgcacatatcagatgctgtttttcccttaacctttgcacttttcattgaaaatgttttcaaatcaaatcttgttttattgggtttcacatgattggactaatacttacatatatgcttctttttaaggtatttagacattgacaattagttatttccttatgagccatagctttgaaaaaccattttagaagaaatttccattttttaaacaaaagtgttgggaggccgaggcgggcagatcacgaggtcgagaccatcctggctaacatggtgaaaccccgtctctaataaaaatacaaaaaattagccaggcatggtggtgggcacctgtagtcccaggtacttgggaggctgaggcaggagaatggcgtgaacccgggaagcagaacttgcagtgagccaagatcgcaccacaccactgcactccagcctgggcgacagagcgagactccgtcttaaaaaaaaaaaaaaaaaaaaaaaagtgattttttaaagaaaagataccgataatttgtctttgctgtagatgaatgccacgtttttatatactaggactattactgaataatactgtttatttctttagatcaacgaatatattaaattctgtcttttttgttcaaataaacgctgtgagatgattgggaaggctgtgtgttgaagttagatgcaaagttggaccttgtacagtgagcctcttgtgagaactgagccatgaaagataaagcctgtcattcatgtctgccttggcctgtgcccagctttattagtaaaaaccattcagtttttactaatgatatctaccagtatctaaagagaaataccttcatcctctagaagaaaacaaggttacccaaagagctcacttaattccttcctttttccctgaacccttggttttaagtgaagagtaaaatgtactagatatgacactctctctgagtattactgaggattttgtggaaaaggcagtttggtactttatttccagcttagctgcagacttggtgaccctgagcaaatcactcagcctccctttgcctccatttcttcatctgtaaaatggggttaacctgtgcctccctgtctcaccagcatactgagggatcgattaaagaggattaaaaaaatccataaggtacactgattccaaagatgggtagaatgatatttaataatgaagactttctgttatatagcaatttaattttaaaagtatctttaccaggccaggtgcggtggctcactcctgtaatcccagcactttgggaggctgaggagggtggatcacgaggtcaggagatcaagaccatcctggctaacacggtgaaaccccgtctctactaaaagtacaaaaaaattagccaggcatggtgatgagcgcctgtagtcccagctactcacgaggctgaggcaggagaatggcatgaacccgggaggcggagcttgcagtgagccgagatcacgccactgcactccagcctggggggcagagtgagactctgtctcaaaaaaaaaataaaataaaagtatctttacccacttctctgtagtgaatattgactagcattttgaagtaggaactaacaaagtataaaattaagtagattttttatatttatgggtattgttctagtacaaatttatggtgtacactgtcggtctgagtgtgggtttaaaatatatcattgtgcttggctaatttgtagaatgtcttatttgaattgacttcatttatttcagaggaatgcatagatgatcagatcaaactgtcgtcatagcagtgttttcagcacatacgagaatcttagagtttaggagccttagagctcacccagtgcaatttcctgccggaagcagattccttcctggtgacctcaccaacaggtgcttgtgcagccttttcctgaaaactttttgggaaagtgggggctgctacctcactactttgatgtgtaccttttgttcaagaactttctaaaacttggagctaatcatgggttatttcagaagatgtaagcattttaagttttttattgaattccatccttatttaaaaggcctggttatgtaatattttctgttttttttttttttttttgtatggtttcccacattgattaggttgttttcttcattttcttaatagattaaaaatactttcttctctttctatttgtgtcttcttccatttagtatttatgggagggagcaagaagggaaaggatgtctatttttaaaattgactacaatcatgactgttcttcttgtcattctgtagcagctggatttattaccatctcttatttaaaggtccttcagaacacgttgaagcagttcatttcaggtcaatggctggtaagcaatgtcaggacctctggggaaggagaagctgacgggatcccagaggaaagaattgaggttgtttgctcccttgtagaaagcccacagatcccttcccagactagaaaaaaagtgccagagtgtcctgaaactttccttctaaggcacatacttcaaagagactggggattcctttgttttaaatataggtggggtctcacagtgttgcccaggctgggctcaagcgatcctgccacctgggcctcccaaagtgatgggattacaggcatgagccaccatgcacggccatggagattctaatgtggtgccagctgccaggtaagaaagctgtgagacaatgtgttgattttcctttactacgtcaggtttgaggacatcatctagcatcaacgggtaacgtcaccctttgttccatctttgggaaataatagtagtagcttgttactgttagctgacccctacattagcatcaataaagtaaatccctttaactttccttttggcctttcctttctctctctctgcctccccaccagccccgactctctcctgtgtgcgtacacatccacacacacctccatggtattccttctttctcccacctaagggaagctgtgcccgatcttgctgcagtccaggtcaccgtactgagatgagtcagccacagactctaaacactagcagcgattagccgtatgtagccaccaagtgcactgttttagacaggtttacacagctctttgctgtccactcatatcagctgtgtagtagcccaaggcagcctgtcaggcagaagaattaccaaccaaagtggatctattcataagataaaagatccggagtccgtgccctcttaaaaaacttttgtcttcagacatatgggtgcgtgttcatctctggccaaaactttgtttccagtttcaaagggctggttgcgaaggtggccttgtaacctttctgttgccggctctgttagttgcctgataagcagtagctaattcatcctcctcagaatttgagagtggcatctattagattcagaccaccaaggtgcctgcgcgggctctcctggttacgactgagtccccttttctcatctgtggggtgaacgcttctatttgcagaaatttgcttgcatctttttccttttatttattattactttttagagatgcggccttgctctgttgcccaggctggagtgcggtggactcttttcttttgttgatctttgccatcctctgcctggcttaatgaggttctttccctgcgtatttatgtcccaggagctcaccttccccctaggtttttaagaaggaagcagaaaatgttacaaagtataagggattctatgaagtccatagataggatttgctttgggagtagatgatttcttcttattttggtgtaaacatcaatttggatggcaattagaatgtctttagcctctttaaaaagcccttctggggcaaacctttgcaagtcactcagctggcatgtaatgagatttttatttgcatggctttttttttctaagtctctctagaagaacataaggacattctgaacatgcaaggaatacagttattctcacatcaaggatcaattttattttgtatcttcattttatgtcattttcctttattttattcacattaatctagcattaattccccccagagggaatgatatttttggttgctgccacctgtgttattaagtgacagcttttctttatctgcttttctgaatttcatatttatatactttattgtagttttttaaaatctattctagctgggctagaatcttccaagtattaattcataatgaacttccctcttctggaattgtttaggagggctaatgttccatgttcccttcgttgctatagatatgaagttatttcgatgttctttgagtgctttattatagcgataactggtactgcctttgattaaaggtgagctatatggagttaagcatttttatactagtaactatttattgagaattttcagaattctatagctacttgtctttaacagttataagaggcatgtatttttttttccttcatggtctggaagttagttttctctttgtttgggtagatcggaatgagttgttgagctgtgttgaaaacacacatgaatcaaaaaagcagatgtattgtagaaatgtgatgttttcatgtttcgggaatttgaccggaaagctttatgtatgggttttatttttaacaaagcagtaagggcttactttttaccaacttgtgtgtgtgtaaagatgtatttgttcaagctttaagaataaacctgtcaatgtacaaatgcctg

SEQ ID NO: 176898 - DNA, 2547 bp, Homo sapiens
  Payload ID: 14714
  Gene Symbol: RPS6KA6
  Gene Name: ribosomal protein S6 kinase, 90kDa, polypeptide 6
  Uniprot ID: Q9UK32
  ENST ID: ENST00000262752
  CDS Start-End: 9-2246
aaggggagatgctaccattcgctcctcaggacgagccctgggaccgagaaatggaagtgttcagcggcggcggcgcgagcagcggcgaggtaaatggtcttaaaatggttgatgagccaatggaagagggagaagcagattcttgtcatgatgaaggagttgttaaagaaatccctattactcatcatgttaaggaaggctatgagaaagcagatcctgcacagtttgagttgctcaaggttcttggtcaggggtcatttggaaaggtttttcttgttagaaagaagaccggtcctgatgctgggcagctctatgcaatgaaggtgttaaaaaaagcctctttaaaagttcgagacagagttcggacaaagatggagagggatatactggtggaagtaaatcatccatttattgtcaaattgcactatgcctttcagactgaagggaaactgtacttaatactggattttctcaggggaggagatgttttcacaagattatccaaagaggttctgtttacagaggaagatgtgaaattctacctcgcagaactggcccttgctttggatcatctgcaccaattaggaattgtttatagagacctgaagccagaaaacattttgcttgatgaaataggacatatcaaattaacagattttggactcagcaaggagtcagtagatcaagaaaagaaggcttactcattttgtggtacagtagagtatatggctcctgaagtagtaaataggagaggccattcccagagtgctgattggtggtcatatggtgttcttatgtttgaaatgcttactggtactctgccatttcaaggtaaagacagaaatgagaccatgaatatgatattaaaagcaaaacttggaatgcctcaatttcttagtgctgaagcacaaagtcttctaaggatgttattcaaaaggaatccagcaaatagattgggatcagaaggagttgaagaaatcaaaagacatctgttttttgcaaatattgactgggataaattatataaaagagaagttcaacctcctttcaaacctgcttctggaaaaccagatgatactttttgttttgatcctgaatttactgcaaaaacacctaaagattctcccggtttgccagccagtgcaaatgctcatcagctcttcaaaggattcagctttgttgcaacttctattgcagaagaatataaaatcactcctatcacaagtgcaaatgtattaccaattgttcagataaatggaaatgctgcacaatttggtgaagtatatgaattgaaggaggatattggtgttggctcctactctgtttgcaagcgatgcatacatgcaactaccaacatggaatttgcagtgaagatcattgacaaaagtaagcgagacccttcagaagagattgaaatattgatgcgctatggacaacatcccaacattattactttgaaggatgtctttgatgatggtagatatgtttaccttgttacggatttaatgaaaggaggagagttacttgaccgtattctcaaacaaaaatgtttctcggaacgggaggctagtgatatactatatgtaataagtaagacagttgactatcttcattgtcaaggagttgttcatcgtgatcttaaacctagtaatattttatacatggatgaatcagccagtgcagattcaatcaggatatgtgattttgggtttgcaaaacaacttcgaggagaaaatggacttctcttaactccatgctacactgcaaactttgttgcacctgaggttcttatgcaacagggatatgatgctgcttgtgatatctggagtttaggagtccttttttacacaatgttggctggctacactccatttgctaatggccccaatgatactcctgaagagatactgctgcgtataggcaatggaaaattctctttgagtggtggaaactgggacaatatttcagacggagcaaaggatttgctttcccatatgcttcatatggacccacatcagcggtatactgctgaacaaatattaaagcactcatggataactcacagagaccagttgccaaatgatcagccaaagagaaatgatgtgtcacatgttgttaagggagcaatggttgcaacatactctgccctgactcacaagacctttcaaccagtcctagagcctgtagctgcttcaagcttagcccagcgacggagcatgaaaaagcgaacatcaactggcctgtaagatttgtggtgttcctaggccaaactggatgaagatgaaattaaatgtgtggcttttttcctattcttatcaaaggcatcgttgtctgctaaattacttgaatattaagtaatattaaatccccatttttaggggaagtgagatttaaaaaaccattcacaggtccacaatattcatactatgtgtttgcagtagtgttcaagtgtttatttaagcatataattggtgtccaccaggtcctcacaacttctctgcacacaagcttctaaaattcctttcaaataaagttactttaatattt

SEQ ID NO: 176899 - DNA, 8169 bp, Homo sapiens
  Payload ID: 14714
  Gene Symbol: RPS6KA6
  Gene Name: ribosomal protein S6 kinase, 90kDa, polypeptide 6
  Uniprot ID: Q9UK32
  ENST ID: ENST00000620340
  CDS Start-End: 1-2238
atgggtctctctacctcagcaatttggaaaaatactcgagtggaaattgttaatccctatgaagtaaaacgaaaggtgaaggtaaatggtcttaaaatggttgatgagccaatggaagagggagaagcagattcttgtcatgatgaaggagttgttaaagaaatccctattactcatcatgttaaggaaggctatgagaaagcagatcctgcacagtttgagttgctcaaggttcttggtcaggggtcatttggaaaggtttttcttgttagaaagaagaccggtcctgatgctgggcagctctatgcaatgaaggtgttaaaaaaagcctctttaaaagttcgagacagagttcggacaaagatggagagggatatactggtggaagtaaatcatccatttattgtcaaattgcactatgcctttcagactgaagggaaactgtacttaatactggattttctcaggggaggagatgttttcacaagattatccaaagaggttctgtttacagaggaagatgtgaaattctacctcgcagaactggcccttgctttggatcatctgcaccaattaggaattgtttatagagacctgaagccagaaaacattttgcttgatgaaataggacatatcaaattaacagattttggactcagcaaggagtcagtagatcaagaaaagaaggcttactcattttgtggtacagtagagtatatggctcctgaagtagtaaataggagaggccattcccagagtgctgattggtggtcatatggtgttcttatgtttgaaatgcttactggtactctgccatttcaaggtaaagacagaaatgagaccatgaatatgatattaaaagcaaaacttggaatgcctcaatttcttagtgctgaagcacaaagtcttctaaggatgttattcaaaaggaatccagcaaatagattgggatcagaaggagttgaagaaatcaaaagacatctgttttttgcaaatattgactgggataaattatataaaagagaagttcaacctcctttcaaacctgcttctggaaaaccagatgatactttttgttttgatcctgaatttactgcaaaaacacctaaagattctcccggtttgccagccagtgcaaatgctcatcagctcttcaaaggattcagctttgttgcaacttctattgcagaagaatataaaatcactcctatcacaagtgcaaatgtattaccaattgttcagataaatggaaatgctgcacaatttggtgaagtatatgaattgaaggaggatattggtgttggctcctactctgtttgcaagcgatgcatacatgcaactaccaacatggaatttgcagtgaagatcattgacaaaagtaagcgagacccttcagaagagattgaaatattgatgcgctatggacaacatcccaacattattactttgaaggatgtctttgatgatggtagatatgtttaccttgttacggatttaatgaaaggaggagagttacttgaccgtattctcaaacaaaaatgtttctcggaacgggaggctagtgatatactatatgtaataagtaagacagttgactatcttcattgtcaaggagttgttcatcgtgatcttaaacctagtaatattttatacatggatgaatcagccagtgcagattcaatcaggatatgtgattttgggtttgcaaaacaacttcgaggagaaaatggacttctcttaactccatgctacactgcaaactttgttgcacctgaggttcttatgcaacagggatatgatgctgcttgtgatatctggagtttaggagtccttttttacacaatgttggctggctacactccatttgctaatggccccaatgatactcctgaagagatactgctgcgtataggcaatggaaaattctctttgagtggtggaaactgggacaatatttcagacggagcaaaggatttgctttcccatatgcttcatatggacccacatcagcggtatactgctgaacaaatattaaagcactcatggataactcacagagaccagttgccaaatgatcagccaaagagaaatgatgtgtcacatgttgttaagggagcaatggttgcaacatactctgccctgactcacaagacctttcaaccagtcctagagcctgtagctgcttcaagcttagcccagcgacggagcatgaaaaagcgaacatcaactggcctgtaagatttgtggtgttcctaggccaaactggatgaagatgaaattaaatgtgtggcttttttcctattcttatcaaaggcatcgttgtctgctaaattacttgaatattaagtaatattaaatccccatttttaggggaagtgagatttaaaaaaccattcacaggtccacaatattcatactatgtgtttgcagtagtgttcaagtgtttatttaagcatataattggtgtccaccaggtcctcacaacttctctgcacacaagcttctaaaattcctttcaaataaagttactttaatattttttttcttgtttcatacaattatggtttggggagtcattaccaacaatcagtatacatatataatagtataatgacaagcaatgttagtatttttaaacatcagatcctgaaggataggctttttctaatgaaagaaaaacaacaaaaacttattataaaagcttgttattccgtaaaaccaaaggactccattcatttgactcactgtagttactaaaatgtaaacatagtggtttggtgccagagcaaaatacatttgtgctaatatatgaattcttgatatagttggtgccaaagtttttatagaagaattatatctcagataatgtgtgcaggcagatctgtatattatccataataagtggcctcatttagaaataaaggtttttataaggcttctgtaaattttacatcatggaaatttagtacaagtgaaactttttttttttccaaaggctttatactgttggtgtaatcttataaataggtcatagttaagcctttgaaaatgaagtatgtggtgttgacactatcctggtgttatataaactgactttcaagttaaccaattggattgtaatcatcatctatcccctttataaatgaactacactgttgtttttctgacttcgatgtgctttgaagtacagtgtagcatatcattctaccttgaatcctatgataatacagttgacatcttgctgtagtggacttgtgcatatagcacacatgatatagtatattgtattacagtaaactttagacaatgctacttaatcattttacttcatgaagataaactaacattttaaatatgaataatattaatggtctacaaaaaatttgagcacattttaaaatcatatttataaaaaactggccaaattggtcttatttaatgtataattcagaaccactgtgtagtatgtattcttttctctaaatgatgaaatgctaaagaatcatttcacgttgttgaagaaaataccgttgctacaacaacagcagcagctactactgctactactactactactactactactactactactactgacagaaagaattcatgaatgtaaactggaggatatcacagttttctttagtgaatataagtgaactacttgtgcgtgttaggtgtactatttgctatgtattttattttgctttattcagagagaaagttgattactgagtgctgaattatacaatttaggctaggaaactcgtaactttggtatttaataaaagaaactatacatattctgtttgtaatgtaaataatctataccccatgcacaaatatctgtttcctgggtgtgatatattaaagtatgtattcttattttgaggtatcttttggaaataattgaaagagattaaataacaatttatgccacatgaaaaataattacttagaagtagttaggtatcatgtcttatggctttttatgttccattttggctttttttctcatttgctttattactatatgtacttgcatgtaacagtttgtaagcatatattctgacttattttccttctgtcattatctagtgctgttatgccttcctatcagaatcgataagtcaaactcagaggtgtgattttggtgttgaagttttcaggacagagatactatttccatggatgcattttaagtaataaaattaggggaagtgaaatcagaaaatgaaaaatgattacaaaataactttcaggttttctataatcaatggctttaaaaagtagacagtcttaattaattttaaattagcttgctcagaaaggtcatgccatacagtcctatcataaaaggaacactataagaattaagcaatgaacagcatgatttctgatcacccagtgaggactgacagtgtataaaagatacaggtatgctactggatgtacccgataattgtttgagagttttctagtgaaaaactcaaatatgctagcttaaccacagtagtagggggcaaccttattatatgggagagcttcaaaacatactgtcattttgtagaaggagcccaggtaaggatgcctaatcctgtccagtttggctagaactccatagccaaaaatgcagatttggattgaacatttttttgatgggacttctatcaatgcttaactagtaaaaacacatcttttctataagactttagaatactgtggtttctaatgggttcttgaataatgattttgcattgtgtttttctagttaatggtttttggtagtatttaatgatagcacagtttggggttttattgttcttgaagggggaggatattgaatttgtttttcttagagaaaacatcaggtttgctcaaatagactaacaacctgttgtccttaagcacatactaccatgaataaactcaggaaacaattttcaagaaaattcgaatgcagtgctggtgatggggatttttgtgggaaaaaacaatggtttcaagtcctttcacaaagatcaaacttcagcctattttgttagactcagcaatgtctaaaacagtgttttttgtaatttattgtcattggtaattcaatataataaaacaattttgatagcacctctgtttggctcaaagggattccatatgtttaggcaacccacaaccttaagaacagatgcttggtatttataatgtctgcccattggaacaacatgttaaaatagtactgcccagagaaacttccatacagattgactagtattttctagatagaggtctttcatatatgaagaaggaaaacaaccatttatcttggccctaaggcccacaagaaaacttaggctttaaagtgggcaaagcatatttgtggtattctgtacattctctttctcctggctttccagccccttcatgctatctatcttatttgagcacctcacagcaatactccatcaacgaaatttaccctatccccagaaggattctgtgtgatccttactccttgttccttcctcttcctcttccccaaatcaggatatccattctatcagaacagacatttccagctaaaaaggtgaaaggaaagctatcttattaaattaatttacatttttctgtcagtggctaatagttaattggcattttttaaggaagttgtgcattaatcaagtttttagttgctggatcttcaggcaatctaacaaggtgataattttaaattcagttcctatcacggaaaatattttgggggaaaggaacagtgtgtcccagggtcagagtatctaataaactgtttctttttttgcacaatttccttcctacttcctttctacttctcaatctaccttttctcttaaaaacttttaaactttttaatcacaatgaacttctatgacaaaatgatgtggaggtagacagagattggcgattatttctgtatatgttgtttttaaacccatagttttgtattcttgtttctcacagtacatgacctatatagcataagaagttttattccccccaccccccatcccattcctgttataaagaaaaaaaaaagcacagagagattgaatccaaactactcatggagtccaaatttttccagatcccttttccagattttaggacctagaaatcctttaagtcacaatgttatttcaaaaaaaaaaaaaaaaaaatgcaagccatattaagtatatattggccaactgcaattaaacttctttaaaacatttttgttttacatttcaaagcttattcaggcatttttggcatgtacctcaagatcaatgattgttgaaattagcagaataaatcaatagtgggctatttgcctttttatgtgggaatatagtggcattgatagtgattattcacaacatacattatactcatggatgcactgttcctggttttagtcttacagtgtagtgaattccatcatatactttcaataaaatgttatgcttgatcacctaaaattcagtttggttgctaatacataagagaaaagggaactatacttgaatatattaaattatagacataagtttctttgaaatatttagaaaaacaaaagttttagaatatggaaatccaagcttacattatattggcaaattatgtatgtttcaattattcactaaataaattttagctaaatgcttataaataaatatatatatgtaattgccaagttagggtttgctttgtattcacatttctaaacgctggacaatagagcttctgtggatgactgttttgctgtaattccaactgtctagttatgggaactaataatttattcttcaaaaggtattaagcatttaattttacgtggacaattatagagaatgtactaactgcattcgtttattaaaaaattgtcaaaatgtgactgattaggttacttttatctttcctatgaactaatattgctcaggtcacattttctttctctttccaaattcattctctctgaaattgctgcttataacaaatatgtagtgttttgttttttagtatgataaaattatttttaacagcaggaaagcagtctatcaagaaacagccggccgggcacagtggctcatgcctgtaatcccagcactttgggaggccgaggcggtggatcacctgaggtcaggaattcgagaccagcctgaccaacatggagaaacccgtctctactaaaaatacaaagttagccaggtgtggtggcgcatgcctgtaatcccagctactcaggaggctgagacaggagaatcacttgaacctgggaggcagaggttgcggtgagccgagattgtgccaatttcactccagcctgggcaacaagagcgaaactccgtctcacaaaaaaaaaaaaaaaaaaaaaaaaaaaaaaagaaaagaaacagccatttaaaaagttacacattaaaccttaaatatccaaattccagcatggtttgtaagttagaatttatcttgcattaaattccatagtacaaaaaaaaggagaaggtggtttttctgtttgataaaaaaaaaaaaaaacaggaagtactgttggtagttgggagttacataggctttatgaagcaaccacagtttgctatagccacattttttaaaaaattggtttgccaacacatcccaagcacttttgaattcctaaacttatttctgatattaaatatatatgtatatactgacatttcattgcatttctgaagactgaaatggcattaaataaaagttgtgtgtgaatttgatttacgtgtacttaaaaacttcaaagctgcagttaaacaatccccagtgttcaaaaactattttattgttctgactatattatgaattttatgttaccatttattttattaatgttttctttaaaccattggttttttgacattaaaattttcatttattatactaagttttttatcatgtaagaccaaatccagtagttcattttacaatgtttctttctctcacaatgctgctaaagaaatggctatcattttgaatttacaacatgccaaagaagacatagaagttatatttatttttgttcttgttaaaactctgtgagcaacagttctcaagatatgttaaattactggcattctctgggtaccaaataaaaaggctgcaactttctaacatttt

SEQ ID NO: 176900 - DNA, 5195 bp, Homo sapiens
  Payload ID: 14715
  Gene Symbol: RPS6KL1
  Gene Name: ribosomal protein S6 kinase-like 1
  Uniprot ID: Q9Y6S9
  ENST ID: ENST00000354625
  CDS Start-End: 486-2135
gaggggtcctcactcgctgaccacactgacctcaggaccaagggaacaaaacacagcaggggcaatccatccggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgactggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaacccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctcttagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggcctacggtgttctcgcttcttccatgcaatgaccacggctcattggggcaggttggaaggctcccctgtagaagctccagagtgaagtcaagagcgagcttggggctgccaggaagtaggacgcagggctggtggtgagcagcatgccatgtgggcctcaggggaaggggtggggtcggggaggaccaggttctgtggggaagaggatgaagaagccttggaagaggctcatggtgcctgggggaataccagtttcatcctcacagtgaccccttgcaacagacggtagctcctgagaaaactgaagctcaaaaaggttaaggacacaacctagccagagttgcaagttagtgttccttctgctactctccctaagtcaggctggaccacttccaaccaccgcttcatgaagcacaagtcccttctggaacttctgtgcttcatccacccaaagctacacatctgacactttgttgggccctgagtttagaatactgtgggtcccagctcttacagtcgacctcctttcgataaaatggggtaaataatgcctattttgcaggtttaccagatagataaattaaagcttctaacaccaaatcctgttcttcctttcattcaacctaatttgtttttctatctactagagctctagttctactctctgggacccacttccctcctgtgacagaccttcacagagggatggcctcactgcaagagctcagcagacagggactctggaaaagacaaggctgtgtttaagcctggactccatcacacctgccacctgcagtctaggttagctacccaccctgtacactcacgctcactgaccactgctcctaggtcatcaaccctcacctgttcatgtgtattgaccttgagcatcttggtccacaaggctatcaaatccaaatgaaatgagatgcccccactcctcccaaatccatcactgaaataatgtaagcccacacaaaaaatgcaagtctactggtgttttgaaagggcttcacaaagatggtgaccccaaattctctattctagagtatggcttgacaggctcaaggaaggtggggcactaagagactatgatgctttatggaaacaaaacaaaaaacatcctaagccccccaaccatctgtatggacccctcgtctcagtcaagggtattccaaagttaacctgaaacgctagttcgggccatggtgggaagagggagccagccattcctcattatactcccctcccttttggaattactgttaaaacaggctccttaagtctgatgagaagcatttacaatctattttctctgaagcctgctggctggaggcttcatctgcataaaaccttggtctccacaaccccttactgtaacccagacattcctttctattgattccaggtctttagataataactctttcaaccaattgccaatcagaaaatctttgattctgcctatgacaacatccccaggtcttgagctgtcctgcctctccagaccaaaccactgtacatcttacatgtactgactggtatcttatgtctccctaaaatgtattaaatgtataaaactaagttgtagccagacgaccctggacacatgttctcaggatctcctaagagttgtatcacaggccatcagtcactcacacttggctcagaataaatctcttcaaatattttt

SEQ ID NO: 176901 - DNA, 2425 bp, Homo sapiens
  Payload ID: 14715
  Gene Symbol: RPS6KL1
  Gene Name: ribosomal protein S6 kinase-like 1
  Uniprot ID: Q9Y6S9
  ENST ID: ENST00000557413
  CDS Start-End: 746-2395
cttgcggctttaaggccggcaggagccgagccgggcggtgattggtggtttattctaaggctcaagtatgagctcatccgcagccaatggccgcgctgcaccggctggccccgcacgctggatgccggaaagcagcggcccgcggcgcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatccggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgactggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaacccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctgg

SEQ ID NO: 176902 - DNA, 2457 bp, Homo sapiens
  Payload ID: 14715
  Gene Symbol: RPS6KL1
  Gene Name: ribosomal protein S6 kinase-like 1
  Uniprot ID: Q9Y6S9
  ENST ID: ENST00000555009
  CDS Start-End: 218-1843
cagatatcctcagctctctccagagctcaacacagtaccagatgctccagaaatgtttgctgaactgaatttgactggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaacccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggacatctctggagactcatctcaggacactgatccactggctcagtggacccaaaccagactgtcctggctagtcctcttagtcacacagcgagtaggcctcttccaccagaagctgttcgtgcagctggggaggcccagaagcagggatgccatctgttgtgcagggagggatgaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 176903 - DNA, 607 bp, Homo sapiens
  Payload ID: 14715
  Gene Symbol: RPS6KL1
  Gene Name: ribosomal protein S6 kinase-like 1
  ENST ID: ENST00000553789
  CDS Start-End: 1-474
accatcatcccacacggagtcccctacatgacgaagctgctcaggtactttgtgagcgaggactccatcttcctgcacctggagcatgtgcaaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctg

SEQ ID NO: 176904 - DNA, 630 bp, Homo sapiens
  Payload ID: 14715
  Gene Symbol: RPS6KL1
  Gene Name: ribosomal protein S6 kinase-like 1
  ENST ID: ENST00000553315
  CDS Start-End: 1-138
gcactgtcccagagccacccttcaggaatccaggcccacacccagctccagctgcccgagtggctcagtcgcccagcggcctctctgctgactgaggtgaggtgtagcccggccagaggaagcagctgcctagcctgaggaagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccat

SEQ ID NO: 176905 - DNA, 527 bp, Homo sapiens
  Payload ID: 14715
  Gene Symbol: RPS6KL1
  Gene Name: ribosomal protein S6 kinase-like 1
  ENST ID: ENST00000553971
  CDS Start-End: 1-313
catcttcctgcacctggagcatgtgcaaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatgctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaa

SEQ ID NO: 176906 - DNA, 583 bp, Homo sapiens
  Payload ID: 14715
  Gene Symbol: RPS6KL1
  Gene Name: ribosomal protein S6 kinase-like 1
  ENST ID: ENST00000556776
  CDS Start-End: 558-583
cgcgctctggcgtgaagggccggtacgtgagggggaggcctggcccgcggacccggctcccagctcgggcaggaggggtcctcactcgctgaccacactgacctcaggaccaagggaacaaaacacagcaggggcaatccatccggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgactggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcct

SEQ ID NO: 176907 - DNA, 2157 bp, Homo sapiens
  Payload ID: 14715
  Gene Symbol: RPS6KL1
  Gene Name: ribosomal protein S6 kinase-like 1
  ENST ID: ENST00000556848
  CDS Start-End: 1-224
ggagtgtgagagaggagcaggtgaagcagtgggcggcagagatgctggtagcgctggaggcgctgcacgagcagggggtgctgtgccgggacctccaccccgggaacctgctcctggaccaggcagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgaggtgaggtgtagcccggccagaggaagcagctgcctagcctgaggaaggtgctgggaggggcacagaactgtgtctgaaccacgtgtgcttcgtgctcagtgtctgatgtgggtgcagagggcagtaggggcaacacatttctatatgttggtggccaaccaccaccaatgttcccagggtaaaatgggggttctgtgggccaggctgccagggagcaggccccctagaggccatagtggttggagtccctggaggtcaccccatgcctccacagctggagtggcccagctgactgggcctctctctgcagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctcttagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggcct

SEQ ID NO: 176908 - DNA, 1247 bp, Homo sapiens
  Payload ID: 14715
  Gene Symbol: RPS6KL1
  Gene Name: ribosomal protein S6 kinase-like 1
  ENST ID: ENST00000555910
  CDS Start-End: 1-146
cagcggcctctctgctgactgagctgctgcagttcgagcctacccggcgcctgggcatgggagaaggtggtgtcagcaaactcaagtcccatccctttttcagtaccatccaatggagcaagctggtgggtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctcttagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 176909 - DNA, 3309 bp, Homo sapiens
  Payload ID: 14715
  Gene Symbol: RPS6KL1
  Gene Name: ribosomal protein S6 kinase-like 1
  Uniprot ID: Q9Y6S9
  ENST ID: ENST00000555647
  CDS Start-End: 289-1938
gctgcaccggctggccccgcacgctggatgccggaaagcagcggcccgcggcgcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatccggtccacggagaagtgctaaaccccaaagggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaacccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctcttagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 176910 - DNA, 786 bp, Homo sapiens
  Payload ID: 14716
  Gene Symbol: RPS7
  Gene Name: ribosomal protein S7
  Uniprot ID: P62081
  ENST ID: ENST00000304921
  CDS Start-End: 165-749
gggactctctagcctcctaccgcttctcagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagta

SEQ ID NO: 176911 - DNA, 764 bp, Homo sapiens
  Payload ID: 14716
  Gene Symbol: RPS7
  Gene Name: ribosomal protein S7
  Uniprot ID: P62081
  ENST ID: ENST00000403564
  CDS Start-End: 143-727
ctcttcctaagccggcgctcggcaaggtaggttggcggcctgctctccgacagaacttttcttcttgggttgaggaaaacgccttttggagtcaggccctggaggggcgagccttgctcacaggttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagta

SEQ ID NO: 176912 - DNA, 704 bp, Homo sapiens
  Payload ID: 14716
  Gene Symbol: RPS7
  Gene Name: ribosomal protein S7
  Uniprot ID: P62081
  ENST ID: ENST00000406376
  CDS Start-End: 101-685
ggcggcctgctctccgacagaacttttcttcttgggttgaggaaaacgccttttggagtcaggccctggaggggcgagccttgctcacagggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaa

SEQ ID NO: 176913 - DNA, 833 bp, Homo sapiens
  Payload ID: 14716
  Gene Symbol: RPS7
  Gene Name: ribosomal protein S7
  ENST ID: ENST00000407445
  CDS Start-End: 48-611
ggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttagtgtaaccagtctccatgcgccaccatagcaatgactgtagtaaactcaggactagttcttttacccgcacttcagcctgctctcctttggattatgtgtcaggtgttaaatggagatgtttcaagaattgaacacttgaaattctctgtaccttttggaagtagactctttctgtggtcttttagttaggctgtatattcttggtgagttaggggtgggtgg

SEQ ID NO: 176914 - DNA, 685 bp, Homo sapiens
  Payload ID: 14717
  Gene Symbol: RPS8
  Gene Name: ribosomal protein S8
  ENST ID: ENST00000372209
  CDS Start-End: 25-591
tctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatatatgactgttttctctgcttta

SEQ ID NO: 176915 - DNA, 881 bp, Homo sapiens
  Payload ID: 14717
  Gene Symbol: RPS8
  Gene Name: ribosomal protein S8
  Uniprot ID: P62241
  ENST ID: ENST00000396651
  CDS Start-End: 161-787
ctcctaggctcgtggccctaggcgcggcagctgacacgtaagtctcgtcgcccgacgttgtttcggcgctcagaaacaacgtaaagtaaaggggcggggcagcgttttacaaaccgaaccgtgaatctttgcggtttctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatatatgactgttttctctgcttta

SEQ ID NO: 176916 - DNA, 829 bp, Homo sapiens
  Payload ID: 14718
  Gene Symbol: RPS9
  Gene Name: ribosomal protein S9
  Uniprot ID: P46781
  ENST ID: ENST00000302907
  CDS Start-End: 173-757
tccactgcttctcagccagccaacgcctcttctgattggctctgacgtgcgtggtgcgtgaaaacgtcacgagacgccggcgttactataagagcgcagccgtggcgcttccgcgcctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176917 - DNA, 510 bp, Homo sapiens
  Payload ID: 14718
  Gene Symbol: RPS9
  Gene Name: ribosomal protein S9
  ENST ID: ENST00000391751
  CDS Start-End: 41-280
gggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176918 - DNA, 772 bp, Homo sapiens
  Payload ID: 14718
  Gene Symbol: RPS9
  Gene Name: ribosomal protein S9
  Uniprot ID: P46781
  ENST ID: ENST00000391752
  CDS Start-End: 116-700
ccgggtggtttgcttaggtgaggtgcggtggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176919 - DNA, 709 bp, Homo sapiens
  Payload ID: 14718
  Gene Symbol: RPS9
  Gene Name: ribosomal protein S9
  Uniprot ID: P46781
  ENST ID: ENST00000391753
  CDS Start-End: 53-637
ttacgctcacacttctctcccgcgcaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176920 - DNA, 1617 bp, Homo sapiens
  Payload ID: 14718
  Gene Symbol: RPS9
  Gene Name: ribosomal protein S9
  ENST ID: ENST00000402367
  CDS Start-End: 116-535
ccgggtggtttgcttaggtgaggtgcggtggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggcccgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggcagagccttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcggatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgctgcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176921 - DNA, 944 bp, Homo sapiens
  Payload ID: 14718
  Gene Symbol: RPS9
  Gene Name: ribosomal protein S9
  ENST ID: ENST00000445961
  CDS Start-End: 116-535
ccgggtggtttgcttaggtgaggtgcggtggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176922 - DNA, 2384 bp, Homo sapiens
  Payload ID: 14718
  Gene Symbol: RPS9
  Gene Name: ribosomal protein S9
  ENST ID: ENST00000448962
  CDS Start-End: 57-290
ctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcgggagcctctgattcctggcggagagccacagtgagcccagcagaacccatctgagcgccagcatccagcccggtcaggaggatttgctgccccctcctggtggaatgcgcgccatgtcgtcaagcggccaccagatgactcgctcgctggtccactcaaaggcatcacatccagagcgctctgctggtcacagatttttcagctgggactttctggagctgtttttctaagctgactttcttgtgtgtttggttcccctttggttggtgccctgatcccaccctcggtgggcccacaggttcccccagtccctgctcacccaatgtcctgtgtttgctctgacgccgacattggaggaggaggacgagcggcaggacaaaggccactgagaccccggttacaacccccaggtatcttcccagaccttgcgcgtgatgacgtcgggaatgaggatgacatcgctgatgtgagcacctactgtgtgcaggcgcgtgctgggtcttcatgagctctaaccctcacagcagtcgtgcaacgtgggattgccaaccccccaacccatttcacagatgcacaaactgaggctcagaggggggaatcgcctgccccaggccccccagcctggaagaagcaggtctgggaggggaacctgggaccttgtgttttccccagctgtcctcctgctgccccaccaggtggacacctgcttcctgctctgggtcttctcatctgacagcaggggcctgtcttagtgtctccatctggggctgtgtcctccttacaaccctcccttccccagcacagcagggcctgggggagggagtgggctgtacaggacggaccctgcattgctctcacccccagcccagccaggtccatctcctactctgccaatccctgaccttcccatgcagagcctttgaccacagactgaagggctgcactgtcggcttctcggcttctgaggttttggtactcggactagcttccttgctcctcagcttacagacagtctattgtgggacctcaccttgtgatcgtgtggatcaatactccttaataaactcccctttatatatacatctatcctgttagttctgcccctctagagaaccctgactaatacatgtttctgaaatacgcagccatagaaggaaatgagaaatgaaacttcctgacacaggcaggaaacctcaggaagcagcgaggtcagagctgagttggcttctggtgacttgcaatgtcagggaatcactaaaagggaggtttccgcctctatatgagacagaggagaaccccagggccctcacagtcagggaggggttggggttttgggtgaaagtgggaagttgtggctcctcgtcccctgtgtttgtggatggcactggggtatctctgctcattgactcaggtttatggtcagccctgagcctccccctctgtgtgtgtgaaatagattcattgtagagttgtcagacatgaggttcacactggaccctcccctgctggttacaggcctgagcagactcacaagacccgggcaggtggtgccgtcctcctcttttcaagcctaacgcccagtgcagccctggtagaaaccctctctggcagatgaggcactgggagatgagtgtccaagaatgagaagaaagaggaatcatcctaatgataaaaagtgctatgactggctgcctgcgatggctcacgcctattttcccagcgctctgggaggccgaggtgggcagatcgctggagcccaggagttcgagaccagcctgggcaacatggtgaaaccccatctctactaaaaagacaaaaatgaactgggtgtggtggtgcacacctgtagttccagctacttaggagcctgaggtcgaagatcgcttgagtctggcaggcggaggttgcagtgaactggggtggtgcgccactgcactttagcctgggtgacagagcaagaacctgtctcaaaaacaaacacaggctgggcgtggtggctcacgcctgtaatcccagcactttgggaggccgaggcaggcagatcatgaggtcaagagatcgagaccatcctggccacacggtgaaaccccatctctactaaaaat

SEQ ID NO: 176923 - DNA, 752 bp, Homo sapiens
  Payload ID: 14718
  Gene Symbol: RPS9
  Gene Name: ribosomal protein S9
  ENST ID: ENST00000436445
  CDS Start-End: 49-468
accgggtggtttgcttaggtgaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacagggtccgcaagcaggtggtgaacatcccgtccttcattgtccgcctggattcccagaagcacatcgacttctctctgcgctctccctacgggggtggccgcccgggccgcgtgaagaggaagaatg

SEQ ID NO: 176924 - DNA, 1600 bp, Homo sapiens
  Payload ID: 14718
  Gene Symbol: RPS9
  Gene Name: ribosomal protein S9
  ENST ID: ENST00000441429
  CDS Start-End: 26-496
gcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcaggtaccacctcggatgggcacctgaatcttcctccacctgcccctctgatggttgccctcactaagcctgctgtccctatctcctatgcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggcccgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggcagagccttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcggatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgctgcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaaca

SEQ ID NO: 176925 - DNA, 944 bp, Homo sapiens
  Payload ID: 14718
  Gene Symbol: RPS9
  Gene Name: ribosomal protein S9
  ENST ID: ENST00000610644
  CDS Start-End: 116-535
ccgggtggtttgcttaggtgaggtgcggcggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176926 - DNA, 709 bp, Homo sapiens; identical to SEQ ID NO: 176919
  Payload ID: 14718
  Gene Symbol: RPS9
  Gene Name: ribosomal protein S9
  Uniprot ID: P46781
  ENST ID: ENST00000619229
  CDS Start-End: 53-637

SEQ ID NO: 176927 - DNA, 709 bp, Homo sapiens; identical to SEQ ID NO: 176919
  Payload ID: 14718
  Gene Symbol: RPS9
  Gene Name: ribosomal protein S9
  Uniprot ID: P46781
  ENST ID: ENST00000611921
  CDS Start-End: 53-637

SEQ ID NO: 176928 - DNA, 1600 bp, Homo sapiens
  Payload ID: 14718
  Gene Symbol: RPS9
  Gene Name: ribosomal protein S9
  ENST ID: ENST00000611572
  CDS Start-End: 26-496
gcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcaggtaccacctcggatgggcacctgaatcttcctccacctgcccctctgatggttgccctcactaagcctgctgtccctatctcctatgcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggctcgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggcagagccttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcagatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgcttcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaaca

SEQ ID NO: 176929 - DNA, 2384 bp, Homo sapiens
  Payload ID: 14718
  Gene Symbol: RPS9
  Gene Name: ribosomal protein S9
  ENST ID: ENST00000620356
  CDS Start-End: 57-290
ctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcgggagcctctgattcctggcggagagccacagtgagcccagcagaacccatctgagcgccagcatccagcccggtcaggaggatttgctgccccctcctggtggaatgcgcgccatgtcgtcaagcggccaccagatgactcgctcgctggtccactcaaaggcatcacatccagagcgctctgctggtcacagatttttcagctgggactttctggagctgtttttctaagctgactttcttgtgtgtttggttcccctttggttggtgccctgatcccaccctcggtgggcccacaggttcccccattccctgctcacccaatgtcctgtgtttgctctgacgccgacattggaggaggaggacgagcggcaggacaaaggccactgagaccccggttacaacccccaggtatcttcccagaccttgcgcgtgatgacgtcgggaatgaggatgacatcgctgatgtgagcacctactgtgtgcaggcgcgtgctgggtcttcatgagctctaaccctcacagcagtcgtgcaacgtgggattgccaaccccccaacccatttcacagatgcacaaactgaggctcagaggggggaatcgcctgccccaggccccccagcctggaagaagcaggtctgggaggggaacctgggaccttgtgttttccccagctgtcctcctgctgccccaccaggtggacacctgcttcctgctctgggtcttctcatctgacagcaggggcctgtcttagtgtctccatctggggctgtgtcctccttacaaccctcccttccccagcacagcagggcctgggggagggagtgggctgtacaggacggaccctgcattgctctcacccccagcccagccaggtccatctcctactctgccaatccctgaccttcccatgcagagcctttgaccacagactgaagggctgcactgtcggcttctcggcttctgaggttttggtactcggactagcttccttgctcctcagcttacagacagtctattgtgggacctcaccttgtgatcgtgtggatcaatactccttaataaactcccctttatatatacatctatcctgttagttctgcccctctagagaaccctgactaatacatgtttctgaaatacgcagccatagaaggaaatgagaaatgaaacttcctgacacaggcaggaaacctcaggaagcagcgaggtcagagctgagttggcttctggtgacttgcaatgtcagggaatcactaaaagggaggtttccgcctctatatgagacagaggagaaccccagggccctcacagtcagggaggggttggggttttgggtgaaagtgggaagttgtggctcctcgtcccctgtgtttgtggatggcactggggtatctctgctcattgactcaggtttatggtcagccctgagcctccccctctgtgtgtgtgaaatagattcattgtagagttgtcagacatgaggttcacactggaccctcccctgctggttacaggcctgagcagactcacaagacccgggcaggtggtgccgtcctcctcttttcaagcctaacgcccagtgcagccctggtagaaaccctctctggcagatgaggcactgggagatgagtgtccaagaatgagaagaaagaggaatcatcctaatgataaaaagtgctatgactggctgcctgcgatggctcacgcctattttcccagcgctctgggaggccgaggtgggcagatcgctggagcccaggagttcgagaccagcctgggcaacatggtgaaaccccatctctactaaaaagacaaaaatgaactgggtgtggtggtgcacacctgtagttccagctacttaggagtctgaggtcgaagatcgcttgagtctggcaggcggaggttgcagtgaactggggtggtgcgccactgcactttagcctgggtgacagagcaagaccctgtctcaaaaacaaacacaggctgggcgtggtggctcacgcctgtaatcccagcactttgggaggccgaggcaggcagatcatgaggtcaagagatcgagaccatcctggccacacggtgaaaccccatctctactaaaaat

SEQ ID NO: 176930 - DNA, 711 bp, Homo sapiens; identical to SEQ ID NO: 103487
  Payload ID: 14718
  Gene Symbol: RPS9
  Gene Name: ribosomal protein S9
  Uniprot ID: P46781
  ENST ID: ENST00000616877
  CDS Start-End: 57-641

SEQ ID NO: 176931 - DNA, 709 bp, Homo sapiens
  Payload ID: 14718
  Gene Symbol: RPS9
  Gene Name: ribosomal protein S9
  Uniprot ID: P46781
  ENST ID: ENST00000615346
  CDS Start-End: 53-637
ttacgctcacacttctctcccgcgcaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacattgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176932 - DNA, 772 bp, Homo sapiens
  Payload ID: 14718
  Gene Symbol: RPS9
  Gene Name: ribosomal protein S9
  Uniprot ID: P46781
  ENST ID: ENST00000610826
  CDS Start-End: 116-700
ccgggtggtttgcttaggtgaggtgcggcggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176933 - DNA, 772 bp, Homo sapiens
  Payload ID: 14718
  Gene Symbol: RPS9
  Gene Name: ribosomal protein S9
  Uniprot ID: P46781
  ENST ID: ENST00000616536
  CDS Start-End: 116-700
ccgggtggtttgcttaggtgcggtgcggtggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176934 - DNA, 510 bp, Homo sapiens; identical to SEQ ID NO: 176917
  Payload ID: 14718
  Gene Symbol: RPS9
  Gene Name: ribosomal protein S9
  ENST ID: ENST00000615167
  CDS Start-End: 41-280

SEQ ID NO: 176935 - DNA, 829 bp, Homo sapiens
  Payload ID: 14718
  Gene Symbol: RPS9
  Gene Name: ribosomal protein S9
  Uniprot ID: P46781
  ENST ID: ENST00000614737
  CDS Start-End: 173-757
tccactgcttctcagccagccaacgcctcttctgattggctctgacgtgcgtggtgcgtgaaaacgtcacgagacgccggcgttactataagagcgcagccgtggcgcttgcgcgcctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176936 - DNA, 711 bp, Homo sapiens
  Payload ID: 14718
  Gene Symbol: RPS9
  Gene Name: ribosomal protein S9
  Uniprot ID: P46781
  ENST ID: ENST00000616082
  CDS Start-End: 57-641
ctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacattgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttac

SEQ ID NO: 176937 - DNA, 752 bp, Homo sapiens; identical to SEQ ID NO: 176923
  Payload ID: 14718
  Gene Symbol: RPS9
  Gene Name: ribosomal protein S9
  ENST ID: ENST00000620740
  CDS Start-End: 49-468

SEQ ID NO: 176938 - DNA, 771 bp, Homo sapiens
  Payload ID: 14718
  Gene Symbol: RPS9
  Gene Name: ribosomal protein S9
  Uniprot ID: P46781
  ENST ID: ENST00000620940
  CDS Start-End: 115-699
cgggtggtttgcttaggtgaggtgcggtggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacattgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176939 - DNA, 1617 bp, Homo sapiens
  Payload ID: 14718
  Gene Symbol: RPS9
  Gene Name: ribosomal protein S9
  ENST ID: ENST00000614095
  CDS Start-End: 116-535
ccgggtggtttgcttaggtgaggtgcggcggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggctcgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggcagagccttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcagatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgcttcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 176940 - DNA, 476 bp, Homo sapiens; identical to SEQ ID NO: 103488
  Payload ID: 14718
  Gene Symbol: RPS9
  Gene Name: ribosomal protein S9
  ENST ID: ENST00000626547
  CDS Start-End: 57-476

SEQ ID NO: 176941 - DNA, 476 bp, Homo sapiens; identical to SEQ ID NO: 103488
  Payload ID: 14718
  Gene Symbol: RPS9
  Gene Name: ribosomal protein S9
  ENST ID: ENST00000627616
  CDS Start-End: 57-476

SEQ ID NO: 176942 - DNA, 476 bp, Homo sapiens; identical to SEQ ID NO: 103488
  Payload ID: 14718
  Gene Symbol: RPS9
  Gene Name: ribosomal protein S9
  ENST ID: ENST00000628741
  CDS Start-End: 57-476

SEQ ID NO: 176943 - DNA, 476 bp, Homo sapiens; identical to SEQ ID NO: 103488
  Payload ID: 14718
  Gene Symbol: RPS9
  Gene Name: ribosomal protein S9
  ENST ID: ENST00000629619
  CDS Start-End: 57-476

SEQ ID NO: 176944 - DNA, 1171 bp, Homo sapiens
  Payload ID: 14719
  Gene Symbol: RPSA
  Gene Name: ribosomal protein SA
  Uniprot ID: P08865
  ENST ID: ENST00000301821
  CDS Start-End: 110-997
gtacataaggacgtcatttcctgccgcctgtcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaagttgtcttcatttagtttgctttttactccagatcagaatacctgggattgcatatcaaagcataataataaatacatgtctcgacatgagttgtacttctaaa

SEQ ID NO: 176945 - DNA, 1032 bp, Homo sapiens
  Payload ID: 14719
  Gene Symbol: RPSA
  Gene Name: ribosomal protein SA
  ENST ID: ENST00000443003
  CDS Start-End: 64-966
tgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccaggtttgtggaacagtgagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttct

SEQ ID NO: 176946 - DNA, 701 bp, Homo sapiens
  Payload ID: 14719
  Gene Symbol: RPSA
  Gene Name: ribosomal protein SA
  ENST ID: ENST00000444512
  CDS Start-End: 354-701
gggtgagttccgtgtagcgtccctggcgccttccagggctagaaaaatgagcttttcctgctcaaatgaagggtgagaagactagtgatgaaagccggtcagactggatctgtctcccgcccggcgcgccccaccttaggcctgcggcccgcacgtggccaggctcgggctggcgggttcccagagtgccccgggagcgggtggaggccgccctccagcggaggctccgagctggggttcggaccaggccgcgggtgggcgggagtgcagaaagcgggctaacatcctgtgttgctatcccttcggagtcccacacggcgattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttc

SEQ ID NO: 176947 - DNA, 874 bp, Homo sapiens
  Payload ID: 14719
  Gene Symbol: RPSA
  Gene Name: ribosomal protein SA
  ENST ID: ENST00000458478
  CDS Start-End: 84-874
cctgcagaggggtccatacggcgttgttctgggttgctctcttatttcagattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaaggtgtacaggtgccctctgtgcctattcagcaattccctac

SEQ ID NO: 176948 - DNA, 1257 bp, Homo sapiens
  Payload ID: 14720
  Gene Symbol: RPLP0
  Gene Name: ribosomal protein, large, P0
  Uniprot ID: P05388
  ENST ID: ENST00000228306
  CDS Start-End: 238-1191
gtctgacgggcgatggcgcagccaatagacaggagcgctatccgcggtttctgattggctactttgttcgcattataaaaggcacgcgcgggcgcgaggcccttctctcgccaggcgtcctcgtggaaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 176949 - DNA, 912 bp, Homo sapiens
  Payload ID: 14720
  Gene Symbol: RPLP0
  Gene Name: ribosomal protein, large, P0
  Uniprot ID: P05388
  ENST ID: ENST00000313104
  CDS Start-End: 74-841
ctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaa

SEQ ID NO: 176950 - DNA, 1218 bp, Homo sapiens
  Payload ID: 14720
  Gene Symbol: RPLP0
  Gene Name: ribosomal protein, large, P0
  Uniprot ID: P05388
  ENST ID: ENST00000392514
  CDS Start-End: 178-1131
gtctgacgggcgatggcgcagccaatagacaggagcgctatccgcggtttctgattggctactttgttcgcattataaaaggcacgcgcgggcgcgaggcccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtctctggactcttaa

SEQ ID NO: 176951 - DNA, 720 bp, Homo sapiens
  Payload ID: 14720
  Gene Symbol: RPLP0
  Gene Name: ribosomal protein, large, P0
  ENST ID: ENST00000552292
  CDS Start-End: 326-649
gacaagtgaatgaagttcacatctggaaatcgttgaacatttttcgttcatggaactcaatggctacgttagtcgtttatgcttttcactgttgtggtaggggctttggaagtaaatgccatcaacaatggatacagaagacctggatttggaataagggcaaaatttatttgatggggctgaattgctctgccaggagcatttggtatgagatgaaatggcctctcttgagactgagctgccaacctggcaattattgtctgctaagggttctctttattcacccttacttggacttcctttcctgtagggaatctcacgtaaaatgaaatcttccctcccccagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaa

SEQ ID NO: 176952 - DNA, 770 bp, Homo sapiens
  Payload ID: 14720
  Gene Symbol: RPLP0
  Gene Name: ribosomal protein, large, P0
  ENST ID: ENST00000546990
  CDS Start-End: 33-770
ccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagcccca

SEQ ID NO: 176953 - DNA, 1003 bp, Homo sapiens
  Payload ID: 14720
  Gene Symbol: RPLP0
  Gene Name: ribosomal protein, large, P0
  ENST ID: ENST00000550856
  CDS Start-End: 262-1003
ggttgcctgtattcgttcagctttgtctgacgggcgatggcgcagccaatagacaggagcgctatccgcggtttctgattggctactttgttcgcattataaaaggcacgcgcgggcgcgaggcccttctctcgccaggcgtcctcgtggaaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgag

SEQ ID NO: 176954 - DNA, 402 bp, Homo sapiens
  Payload ID: 14720
  Gene Symbol: RPLP0
  Gene Name: ribosomal protein, large, P0
  ENST ID: ENST00000551914
  CDS Start-End: 38-402
ttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataagctgctgcccgtgctggtgccattgccccatgtgaagtcactgtgcca

SEQ ID NO: 176955 - DNA, 966 bp, Homo sapiens
  Payload ID: 14720
  Gene Symbol: RPLP0
  Gene Name: ribosomal protein, large, P0
  ENST ID: ENST00000551258
  CDS Start-End: 64-534
gcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtgtttactgccccactattatctggttcagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcgg

SEQ ID NO: 176956 - DNA, 1106 bp, Homo sapiens
  Payload ID: 14720
  Gene Symbol: RPLP0
  Gene Name: ribosomal protein, large, P0
  ENST ID: ENST00000549098
  CDS Start-End: 77-250
cttctctcgccaggcgtcctcgtggaagtgacatcgtctttaaaccctgcgtggcaatccctgacgcaccgccgtgatgcccagggaagacagggcgacctggaagtccaactacttccttaagatcatcgtaagtgcaggcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctt

SEQ ID NO: 176957 - DNA, 993 bp, Homo sapiens
  Payload ID: 14720
  Gene Symbol: RPLP0
  Gene Name: ribosomal protein, large, P0
  ENST ID: ENST00000546989
  CDS Start-End: 77-922
cttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaa

SEQ ID NO: 176958 - DNA, 1344 bp, Homo sapiens
  Payload ID: 14720
  Gene Symbol: RPLP0
  Gene Name: ribosomal protein, large, P0
  Uniprot ID: P05388
  ENST ID: ENST00000551150
  CDS Start-End: 317-1270
aggcgtcctcgtggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtc

SEQ ID NO: 176959 - DNA, 561 bp, Homo sapiens
  Payload ID: 14720
  Gene Symbol: RPLP0
  Gene Name: ribosomal protein, large, P0
  ENST ID: ENST00000550423
  CDS Start-End: 228-561
gagctccctgtctctcctcagtgacatcgtctttaaaccctgcgtggcaatccctgacgcaccgccgtgatgcccagggaagacagggcgacctggaagtccaactacttccttaagatcatcgtaagtgcagggtctgaggtcaggaatgactcattgtaaggaagcaagctgttgcatatttaggacctgtcagccaagaaacttaagtgtccaatgacttttggatggcctttgagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagccc

SEQ ID NO: 176960 - DNA, 781 bp, Homo sapiens
  Payload ID: 14720
  Gene Symbol: RPLP0
  Gene Name: ribosomal protein, large, P0
  ENST ID: ENST00000547211
  CDS Start-End: 50-781
gtgacatcgtctttaaaccctgcgtggcaatccctgacgcaccgccgtgatgcccagggaagacagggcgacctggaagtccaactacttccttaagatcatccagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaag

SEQ ID NO: 176961 - DNA, 864 bp, Homo sapiens
  Payload ID: 14720
  Gene Symbol: RPLP0
  Gene Name: ribosomal protein, large, P0
  ENST ID: ENST00000547173
  CDS Start-End: 43-543
cgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgtttactgccccactattatctggttcagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaa

SEQ ID NO: 176962 - DNA, 680 bp, Homo sapiens
  Payload ID: 14720
  Gene Symbol: RPLP0
  Gene Name: ribosomal protein, large, P0
  ENST ID: ENST00000547191
  CDS Start-End: 222-680
tctctcgccaggcgtcctcgtggaagtgacatcgtctttaaaccctgcgtggcaatccctgacgcaccgccgtgatgcccagggaagacagggcgacctggaagtccaactacttccttaagatcatcgtctgaggtcaggaatgactcattgtaaggaagcaagctgttgcatatttaggacctgtcagccaagaaacttaagtgtccaatgacttttggatggcctttgagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtg

SEQ ID NO: 176963 - DNA, 792 bp, Homo sapiens
  Payload ID: 14720
  Gene Symbol: RPLP0
  Gene Name: ribosomal protein, large, P0
  ENST ID: ENST00000547475
  CDS Start-End: 42-470
gtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaag

SEQ ID NO: 176964 - DNA, 1197 bp, Homo sapiens
  Payload ID: 14721
  Gene Symbol: RPLP1
  Gene Name: ribosomal protein, large, P1
  Uniprot ID: P05386
  ENST ID: ENST00000260379
  CDS Start-End: 166-510
tggacacataagaggctgcgtataggcgcgagagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttactgctgttggtcttgtccatagttttggaatgtgctctgcaaaaatggtctgttttgtaatgttggctttcagcctattctgccatgacacaggctggattttccctgccaccattgccggatgtgagatttagacaatcctgatgctaacaagaaggcacctcatggtacagtgttgaaaactgcactggggtggcaggaggaaggatcagagcagatgctttgtccaggttacctgtgtaaacttgatgattataaggtgtgtcccctacactgggggtggagggtaatacagaccagctttagaaagcctcctgggtatttaccctatacaaccctgcctaagaacgaactttgacgtatgctgaatgttgactgctacatcccaaggttgtaaaaaaacaagacttagctatgtaatgtctcaccaaatgtttgggagttttatggtaacactgaaggagtgcagaaagtttacttaatagtttattaaggtctccagttacacaaagtggaaaaaaaaaaagattcaaacctgtgttccaaaaactaagagctttttttgtttgccaattaataataccatgaatggaattttcaacttttcaggcttggatttatataataaaccgtgggtattgtgtgttc

SEQ ID NO: 176965 - DNA, 445 bp, Homo sapiens
  Payload ID: 14721
  Gene Symbol: RPLP1
  Gene Name: ribosomal protein, large, P1
  Uniprot ID: P05386
  ENST ID: ENST00000357790
  CDS Start-End: 136-405
agagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttac

SEQ ID NO: 176966 - DNA, 256 bp, Homo sapiens
  Payload ID: 14721
  Gene Symbol: RPLP1
  Gene Name: ribosomal protein, large, P1
  ENST ID: ENST00000560274
  CDS Start-End: 66-230
ggccctcacttcatccggcgactagcaccgcgtccggcagcgccagccctacactcgcccgcgccatggcctctgtctccgagctcgcctgcatctactcggccctcattctgcacgacgatgaggtgacagtcacgctgaggagaagaaagtggaagcaaagaaagaagaatccgaggagtctgatgatgacatgggctttggtctttttgactaaacctcttttataacatgttcaataaaaagctgaacttta

SEQ ID NO: 176967 - DNA, 781 bp, Homo sapiens
  Payload ID: 14722
  Gene Symbol: RPLP2
  Gene Name: ribosomal protein, large, P2
  Uniprot ID: P05387
  ENST ID: ENST00000321153
  CDS Start-End: 395-742
ggcatgctgggggtgctaggtaccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatct

SEQ ID NO: 176968 - DNA, 637 bp, Homo sapiens
  Payload ID: 14722
  Gene Symbol: RPLP2
  Gene Name: ribosomal protein, large, P2
  Uniprot ID: P05387
  ENST ID: ENST00000530797
  CDS Start-End: 252-599
ccaccgaggtcgcacgcgtgagacttctccgccgcctccgccgcagacgccgccgcgtgagtgtggtgaccgggcccggggtgccggctggggacgcggagtccgtggggatgcggggtgggcggcggggtatttttgggacggaggcctacgggccgagccacgcgcggcctcgcccggcggccccgggatgggccggcaggaggccgccggggtaactccgccgtcgcgtcctctccgcccgcctcaggatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatc

SEQ ID NO: 176969 - DNA, 313 bp, Homo sapiens
  Payload ID: 14722
  Gene Symbol: RPLP2
  Gene Name: ribosomal protein, large, P2
  ENST ID: ENST00000530398
  CDS Start-End: 1-278
tagggggcaactcctcccccagcgccaaggacatcaagaagatcttggacagcgttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacac

SEQ ID NO: 176970 - DNA, 2254 bp, Homo sapiens
  Payload ID: 14723
  Gene Symbol: RRNAD1
  Gene Name: ribosomal RNA adenine dimethylase domain containing 1
  Uniprot ID: Q96FB5
  ENST ID: ENST00000368216
  CDS Start-End: 631-2058
cgccgacgaagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagggtccacgagctcaagattgaagaatatgtgcagcgggggctacagcgagtggggctagatccccagctgccactgaatctggctgcccttcaggcccacgtggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctg

SEQ ID NO: 176971 - DNA, 1802 bp, Homo sapiens
  Payload ID: 14723
  Gene Symbol: RRNAD1
  Gene Name: ribosomal RNA adenine dimethylase domain containing 1
  Uniprot ID: Q96FB5
  ENST ID: ENST00000368218
  CDS Start-End: 664-1497
aagcgtccggagccggatgcggaaatcggtgcgcgccgacgaagcccgggaaggcaggcgcgcgggttagaacgcgccagaggtcggcgcgcgcacacccgcaccgccccgaccccaggtagtgaggccagtgattccgagtgtgtgaggagcggcagtggcggcggaggagggggcggcgtgggtgggggcgggggcgggatgcgctccccggcccctctagccccgtggtggtacaacgcgaaggtgtgggaaggccgcgataaaccggaactgcagcccgccggacacctccggcttcacttccgtaagaggagaggagtgtacggcaaggggcgggaactggaacttggcccgcctcgttgtgagctgagctcagcggcacgcttttgtggcgtcactgcactgttaccccgccctacgtgtctctgacgctgacaccttctcactgtgaaacgtcgcgacctgtgacgtctggggggcgcctcaaatcttccactccagcatcggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcagatatgtgcagcgggggctacagcgagtggggctagatccccagctgccactgaatctggctgcccttcaggcccacgtggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctg

SEQ ID NO: 176972 - DNA, 709 bp, Homo sapiens
  Payload ID: 14723
  Gene Symbol: RRNAD1
  Gene Name: ribosomal RNA adenine dimethylase domain containing 1
  ENST ID: ENST00000484742
  CDS Start-End: 408-709
tttctagtacctacctagattgtttttgtaatcttcccagatccaaggaatttttcacagacaacctatgggacacactcccttgctcatggcaggaagcattggatggactgaaaccaccacagctggccacaatgctgctggggatgcctggggaaggggaggtcgtcaggtatgggctagaaggtccctgtgctggggaactcaaggctttaagccctgcagtgagcatattgctcagagagtctcataaggtcttcctgggcctcgggttgtaaactgctgcactcagatgtgatgggactattcactggaggcctcggctggactatctcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctct

SEQ ID NO: 176973 - DNA, 459 bp, Homo sapiens
  Payload ID: 14723
  Gene Symbol: RRNAD1
  Gene Name: ribosomal RNA adenine dimethylase domain containing 1
  ENST ID: ENST00000524343
  CDS Start-End: 146-430
aaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagttggtgaaga

SEQ ID NO: 176974 - DNA, 1191 bp, Homo sapiens
  Payload ID: 14723
  Gene Symbol: RRNAD1
  Gene Name: ribosomal RNA adenine dimethylase domain containing 1
  ENST ID: ENST00000519086
  CDS Start-End: 157-1191
cggatcccggaaaggcagcgtcggagactggacccaaaactcttcctgttctgcctgcagagttgagccccgtccgggtcctggacccgcgtagtactgaccctggatccctgttcactgcgttctcgctccccgcgctccctgctggaccccgggatgccgggcatctccgcccgaggcctctctcatgaggggaggaagcagctagctgttaacctcacccgtgtcctggcactctaccgttccatcttggatgcctacatcatcgaatttttcacagacaacctatgggacacactcccttgctcatggcaggaagcattggatggactgaaaccaccacagctggccacaatgctgctggggatgcctggggaaggggaggtcgtcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttaggtgggtagaccccacagccctgtgtgaggagcttctgcttccactggagaacccgtgtcagggcagggcccgcttgctgctcacaggcctccacgcctgtggggatctgagtgttgccttgctgagacacttctcctgctgtcctgaggtggtggccctggcctcagtgggctgctgctacatgaagctgagtgaccctggcggctacccactgagtcagtgggtggctgggctgcctggctatgaactgccctaccggcttcgggagggggcctgccatgccctggaggaatatgctgagcggctacagaaagctggccctggccttcgaactcactgctaccgtgcagcactggagacagtcatccgacgggcccggcccgagctccgtcggccaggcgtgcagggtatccccagg

SEQ ID NO: 176975 - DNA, 416 bp, Homo sapiens
  Payload ID: 14723
  Gene Symbol: RRNAD1
  Gene Name: ribosomal RNA adenine dimethylase domain containing 1
  ENST ID: ENST00000522237
  CDS Start-End: 1-416
agaaccccagccagagctcccgactaacagctccattccggaaacatgtcaggcccaagaagcagcatgagatccggaggctgggagagttggtgaagaagctgagtgatttcacaggctgcacccaggttgtagacgtgggctcaggccagggccatctctcccgcttcatggctcttggcctggggttgatggtgaagagcatcgaaggggatcagagactggtggagagagcccagcgcctggaccaggagcttctgcaggctctggagaaagaggagaagaggaacccgcaggtggtccaaaccagccctcgtcactccccacaccacgtggttagatatgtgcagcgggggctacagcgagtggggctagatccccagctgccactgaatctggctgcccttcaggcccac

SEQ ID NO: 176976 - DNA, 1096 bp, Homo sapiens
  Payload ID: 14723
  Gene Symbol: RRNAD1
  Gene Name: ribosomal RNA adenine dimethylase domain containing 1
  ENST ID: ENST00000476229
  CDS Start-End: 327-791
cttgctcatggcaggaagcattggatggactgaaaccaccacagctggccacaatgctgctggggatgcctggggaaggggaggtcgtcaggtatgggctagaaggtccctgtgctggggaactcaaggctttaagccctgcagtgagcatattgctcagagagtctcataaggtcttcctgggcctcgggttgtaaactgctgcactcagatgtgatgggactattcactggaggcctcggctggactatctcaggtacaggtcagtgtggccactcaccctgctggccctgaagtccacggcgtgtgccctggcctttacccggatgcctggctttcagaccccctcagaattcctggagaaccccagccagagctcccgactaacagctccattccggaaacatgtcaggcccaagaagcagcatgagatccggaggctgggagagggccatctctcccgcttcatggctcttggcctggggttgatggtgaagagcatcgaaggggatcagagactggtggagagagcccagcgcctggaccaggagcttctgcaggctctggagaaagaggagaagaggaacccgcagatatgtgcagcgggggctacagcgagtggggctagatccccagctgccactgaatctggctgcccttcaggcccacgtggcccaggagaaccgtgtggtggccttcttcagcctggctctactgcttgccccactggtggagacgcttattctactggaccggctgctgtaccttcaggaacagggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctg

SEQ ID NO: 176977 - DNA, 3022 bp, Homo sapiens
  Payload ID: 14724
  Gene Symbol: RRP1
  Gene Name: ribosomal RNA processing 1
  Uniprot ID: P56182
  ENST ID: ENST00000497547
  CDS Start-End: 118-1503
gcgggctgtgacgtcacgccacgcgccggggccaggaggaggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggggaagtgtcgcttcaggtgtgtcctacggacgtgtgggaggtggcaggcgccagcctccgagcagtgtggtggtttatattcatgtttgtggaaaaatcttgcaagacatttctcctttcacagaactgcccaggtgttaacagggctgtctggacggggctcttttgcttccccctcaatctggggtctagagttgtgcaaggaattcagctccagtaaggcctggattgcccggggtgagcgtgtgtgtggtgggaagacctggcttccgcgagagccttgttcctggaggcaggagcgccccgccatcctgggtacccgcgggtccgcaggctgcgcacctctttccctcagccaggtcaccctcagcgtcctccctgcccctctccccttcacacctgctggagcctgtgagggaggtggcgggtccccactgtggcgacggagagctgacagtagcccagggctttccacctgcatggaacaagggcctgtctgccgccagcgctgtggccacagcctgcataggtgacaaggggccgctgcgttgggttttgcccgcatcttctgttccatgggtgcccagccagccaggccgtgtgggatccagcgagaggccagggcttggagtgggcctgggaccaggaaggacctctaggctgtggctggccttgtgcagaccctggactgcatccggttccccaaagccctgctgcattcgagtgtcccccaaccccgggcaggtggcacctggtgacacctccttcagtcccactcagctgggcggccggggcaggcttagggcacagttaggggccaaggagagggaaggccagggcccctgttctaggggttagggttctttccccaaaggaacttaaaaagacaagcgtggccaggcacagtggctcacacctgtaatcccagcactttgggaggccgaggtggccagatcacctgaggtcaggagtttgagaccagactgaccaacatggagaaaccccatctctactaaaatacaaaattagccaggcgtggtggcacatgcctgtaatcccagctactcgggaggctgaggcaggagaattgcttgaacctgggaggcagaggttgtggtgagctaagatcacgccattgcactccagcctgggcaacgagagggaaactctgtttcaaaaaaaaaaaaaaaaa

SEQ ID NO: 176978 - DNA, 805 bp, Homo sapiens
  Payload ID: 14724
  Gene Symbol: RRP1
  Gene Name: ribosomal RNA processing 1
  ENST ID: ENST00000483896
  CDS Start-End: 72-209
cgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcagattaaccttgtggccactgtccagcttaggaaaccgtcaaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagac

SEQ ID NO: 176979 - DNA, 4038 bp, Homo sapiens
  Payload ID: 14725
  Gene Symbol: RRP12
  Gene Name: ribosomal RNA processing 12 homolog
  Uniprot ID: Q5JTH9
  ENST ID: ENST00000315563
  CDS Start-End: 53-3646
cgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgc

SEQ ID NO: 176980 - DNA, 4425 bp, Homo sapiens
  Payload ID: 14725
  Gene Symbol: RRP12
  Gene Name: ribosomal RNA processing 12 homolog
  Uniprot ID: Q5JTH9
  ENST ID: ENST00000370992
  CDS Start-End: 140-4033
agtaatgcacacgaatccggaagtgacgccagaagaagaggaagtgaaggctacagggtatccacgtgggttctgagcgtgtttctacgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgc

SEQ ID NO: 176981 - DNA, 545 bp, Homo sapiens
  Payload ID: 14725
  Gene Symbol: RRP12
  Gene Name: ribosomal RNA processing 12 homolog
  ENST ID: ENST00000439965
  CDS Start-End: 353-545
gcatgcgtcctccctctccagtcccgcgtcggtcgccgcagtcacggagcgcacgtcgggaaacctctcagcctcatctgtaaaatgtgatcataaataccgggtacctggaagtgctcgagacagatctcactatgttgaccgggctggtctcaaactcctggcctcaagcagtcctcctgcagcaacttcacagcaacactggaatgacaggttaatgcacacgaatccggaagtgacgccagaagaagaggaagtgaaggctacagggtatccacgtgggttctgagcgtgtttctacgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcag

SEQ ID NO: 176982 - DNA, 4242 bp, Homo sapiens
  Payload ID: 14725
  Gene Symbol: RRP12
  Gene Name: ribosomal RNA processing 12 homolog
  Uniprot ID: Q5JTH9
  ENST ID: ENST00000414986
  CDS Start-End: 140-3850
agtaatgcacacgaatccggaagtgacgccagaagaagaggaagtgaaggctacagggtatccacgtgggttctgagcgtgtttctacgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgc

SEQ ID NO: 176983 - DNA, 4476 bp, Homo sapiens
  Payload ID: 14725
  Gene Symbol: RRP12
  Gene Name: ribosomal RNA processing 12 homolog
  Uniprot ID: Q5JTH9
  ENST ID: ENST00000536831
  CDS Start-End: 190-4083
atgcgtcctccctctccagtcccgcgtcggtcgccgcagtcacggagcgcactaatgcacacgaatccggaagtgacgccagaagaagaggaagtgaaggctacagggtatccacgtgggttctgagcgtgtttctacgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 176984 - DNA, 543 bp, Homo sapiens
  Payload ID: 14725
  Gene Symbol: RRP12
  Gene Name: ribosomal RNA processing 12 homolog
  ENST ID: ENST00000622320
  CDS Start-End: 446-543
atgcgtcctccctctccagtcccgcgtcggtcgccgcagtcacggagcgcacgcctccacctggatcatgagtgtgacagctggagctcctgcagcccatctgtggagcacaaggtgacagtgaaaatggaagtcatacgttatggaggttgaagcagaaaaagagagggatcccaggatcctgaagattctgtggaactgccatagcagcctggactgcccattacctcctgatttccatttcttgaataggccctgagaagaatgaagaatttgaagtggtaaatggggaacggtttaattttgggtaatgcacacgaatccggaagtgacgccagaagaagaggaagtgaaggctacagggtatccacgtgggttctgagcgtgtttctacgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgcca

SEQ ID NO: 176985 - DNA, 459 bp, Homo sapiens
  Payload ID: 14725
  Gene Symbol: RRP12
  Gene Name: ribosomal RNA processing 12 homolog
  ENST ID: ENST00000487612
  CDS Start-End: 1-321
cgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggtgggcccaacgcgcttgtccattcattcaccgtgttcacttattccttcggtgatcacttgctgaggaagcgtggctaaaaacagaccagagaaactcttctctcggcagcttcctcaaactttttgagtttctcaaactttttttgagaaacattaagaaatctttttatgttgtaaccgagccatttatacaatacatatttaacttaaaggaaa

SEQ ID NO: 176986 - DNA, 833 bp, Homo sapiens
  Payload ID: 14725
  Gene Symbol: RRP12
  Gene Name: ribosomal RNA processing 12 homolog
  ENST ID: ENST00000618765
  CDS Start-End: 304-833
tataaggcttacgcctgtggccctgaaacctggtcctggctggagtaagaaccccatagaacccttagcaacctaacttcctccctagcaacggatctccttggagctcctccccatccgaagccaggaggaggtgtaaaaccggatgttgactgttttaccatagtaatgcacacgaatccggaagtgacgccagaagaagaggaagtgaaggctacagggtatccacgtgggttctgagcgtgtttctacgtccctggaagccggtcatttaagctcattcctcgccacggcttagtcaacatgggtcgctcgggaaagttgccttctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcg

SEQ ID NO: 176987 - DNA, 7771 bp, Homo sapiens
  Payload ID: 14726
  Gene Symbol: RRP15
  Gene Name: ribosomal RNA processing 15 homolog
  Uniprot ID: Q9Y3B9
  ENST ID: ENST00000366932
  CDS Start-End: 31-879
actgtcaggtgacgcttccggcgcagaaaaatggcagccgccgctccggactcacgtgtgagtgaggaagaaaacctgaaaaagaccccaaagaagaagatgaaaatggtaactggagccgtagcgtcggtgctggaagacgaggccacagacacttctgatagtgaaggaagctgtggatcggaaaaggaccacttttattctgatgatgacgcaatagaagctgacagtgagggtgatgctgagccctgtgacaaagaaaatgaaaatgatggagaatcaagtgttgggactaatatgggctgggcagatgctatggctaaagtcctcaacaagaaaactcctgaaagtaaacctactattctggtcaaaaataagaagctggaaaaggaaaaagaaaagttaaagcaagaaagactagagaaaataaaacagcgtgataagaggctggagtgggaaatgatgtgcagagtaaagccagatgttgtccaagacaaagagacagagagaaatcttcagagaattgcaacaaggggtgtggtgcaattatttaatgctgttcagaaacatcaaaagaatgttgatgaaaaggttaaggaagctggaagttctatgagaaagcgtgctaagttgatatcaactgtttccaagaaagatttcatcagtgttttgagagggatggatggaagtacaaatgagactgcttcaagcaggaagaaaccaaaagccaaacagactgaagtgaaatcagaagaaggcccaggttggacgatcctacgtgatgatttcatgatgggagcatctatgaaagactgggacaaggaaagtgatgggccagatgacagcagaccagaatctgcaagtgactctgatacataaagcatcataggaaatacaattgcagtcgttttattttttctagaaaaatatgtcatcctctgatagttggggaattataaggataccatttgtaagaaagccaaaagacttttgccagatttcatatttccccttttcatgtacactttatatatacttcattaaaattatattttaaacccttgtataattttaagcattgttcctcagaacatttgtaaaaggatatatttctgcttgaccagcgagatgtgcattttgccaggatcatattggtcatgtctattggtgtattatttcagtatcaccaatgttttcagaaatacagtactaattcatcattaaactctttgaagttaatatttttctgccttctaacttatagactcaactatgtatctgtagtttttgggaatggttggtgttttttgctttgtgttgggaagttattgagaaaacctatataataaaatttaaaattatagtttttcagattttgggtcgtgattttagttttaggtaatctggaagatatgatttaagaaacaacagatttcaactttttttttttttttttttttttttttttttttttttttgagacggagtcttgctctgtggccccggatggaatgcagtggcgtgatctcggctcactgcaagcaccgcctcccaggttcacgccattctcccacctcaacctctcaagtagctgggactacaggtgcctgccaccacgcccagctaattttttgtttttgtatttttagtagagacggggtttcaccatgttagccaggatggtctcaatctcctgacctcgtgatccacccgcctcggcctcccaaagtgctgggattacaggcgtgagccactgcgcccggcccagatttcaacttttattttatttcctttcatttattaaataatataaataatgacagatttattttaggtgttagcctatttttgcatgagagatttacagaggtggaaattctcatgcttaacttatgcaatgagacaatttctcaggaagcaagtttgacatgctttagtctctctcttcttttttttcctcccaaatatttgagttagcttaaattcttttttatggactgcccaaccagtgaattgatgcacttagacaacaagtaatctgcagcagaatattgcatccaatttgagacttgattccatattattgccttaaaggctattaaattgggtgacttttagtatccagctgttaaaaagaggaaagactgtttaatatcattccaaaatttttgtgaaatgtggcccaagatctaaagtttttaagggaattatttttaataaatatgatctgtccctttttgaaaaggatccatcccttttcataataaaaataattccctcctaccacccagttgcacatacttgcatctgttatgtattgaaggataatcccccccaaaaaaactatccaagagcagagatgtttatattttgaaacccatttgagtgttacagtattatatgactaaagctgaatcagtctgtggcctggtatttgttatcataaaggaagatgtacacctaaggtatcaagtggttaaaacagcaaagtacaagatgcatttttgtatttattctaacttttgaacattagtgtctttcagtataaataaatgtgaacaaatatacctcagtagtaatacaggagaactaaatatcctgctataacttaatacagatacatatttcaatatgacttaacaaacacacaattttgaaaaaaaaaaaaaaaaagtgcagcaacttaaacacatttttctccccagaactaagattacacttaatttaatttaatgtgtttctgcgttatactagagttttgcaggaatttttctgaatagtacattcacatgatagatacggataaataccttatttactaaaatgttttgaaacatattttatagtccctcatttgatttgaaaaaatttgacaagatcttcacattgaaagtaaggacgagaatatttgcagatttccttcgttccaaaattattttattccaaagaaaaattgagttgccactatcaggaaaaaaaaaatgtatcacttctgttagaaggctatgaagtatatataaattatatgacaatttttatcatatagatttgatatcttctatgtattcgtatttttgcatcttgggtattaagcaaaataccatatgtataaatatgaaaccaggaatgtgcatattttagaaactaattgtgtatcttaagtgaatgttttgagtagttctgtcacccctattctaaatattttacctacaacatttaaattattctgatatcaatcagataaataatccgagtgtatttcatctttctacattgtctttgtggtttttgtttgtttgtttttgagacggtctcacactgtcacccaggctggagtgcagtggtgcaatctcagctcactgcaacctccacctcccaggttccagctatcctcccacctcagcctcccaagtagctaggactacaggtgtgcaccaccatgcccagctaattttttgtctttttgatgtagatggggttaccccatgttgcccaggctggttgtgaactcctgagctcaagggatccccccgcctcttgcctcccaaagtgcttggattacaggtgtgagccaccataccacctgtctttgaattttttaacgaggggaaagaaaactgcaattcctgcctccccatttatttaaacataacacctaggattttatttttggtaactacttagaataatatagtaggttacttatcttcggttagaaagaactatggaaaataggaaccaataatttggaagtattatttccttatttcatatatagaaataattatcttatttccttatttcatatatagaatattctagatacttggatggctggggttgatgttcttagtatttatcatagtttagcattggttgttatttttaagcatcagaatttgaaagccaatgataatacctgattaggactgaaaatagaattatcttagtagtttagcactttttataatggagttggagcactgaatttattttcaaattacctagaattctgcattgctcaaacattattcaattgattgcaaaatataccttggaaaccctttggatagaacagttcagagggttaccactagtacttagagcctaaagtcactcagtaggaggttctcaaaggtctatttgaaggcaatccaatttctttaaaataaaatattttttgccttttaaaacagatgggtgaagaaagggacgtataaattctgggaaacctcttatgttttcctcccatttccttctatgtctccattaatgtgctaacttgaaggaatttaacttcaaggaaagttgactgatgaagtttatgtagagctgtgaatattataatttgtcaatactttattgataatgttaactttgtttttatttggaaacattttttccagttgaccaaagcagaattcattctgttcttccctcaaattcatctattaggatcaatgtgattgacatttatctccactctgcatgtcactgatatggtatagacgctataagccctgtagatattatgggtatgaagactatttgaggtgaattggcagtgagagcaaattttggaaacaggagagagaactacttcgtgcctataaaaagctctctcactccttccccaagaaaacaggagtctgaattttggccagctgggtatttgaatcttactgactgttgcagcactggtagtcctggtaaattttttcagtgggcgagcttttctgaaatttgattaaacatattagtcaagggaatctgtgaatagatttagaagtagaatgtttgaggtggttgacaagacatttagaattgtgattaatgttttaataaaatgctaagttagaatgaataatcataattatatagatggaagatatattctaacagttcttaaataattttagattctctaaatttagagtgttttctagcttagagagcaatattaatattttttacctagtctactgaacataatttcagggagttagtatttaggactttttacctagagatgcggtaaaccttttaaatttaaatttgctttcttaaaatacctgttccaacattgctcacctttcttctccctcctttttgccctctccttcagtgggaggagcacatattcagctttctgttaaacactctttggttttcaactgagtaaggcaagcaaggatatatgttagaagagtgggcataatactttatattaaaattatagggactaaaagtctaaatcattgctgtcaataggactttttttgatgatggaaataatttatgtctgtgctgttcaatatggtagccactcgcagaggtgactactgagcatttcacgtgtggcttgtgatacagaggaactaaatttttaattttacttaattactttaaattttaaaagttacacgtggctagtgggtctatcccaactatgaagagaataaagctacagagcatctatctagtctaatgaaacaacagtgaatttgggaattgtaaatctgtcttaagctttttccataaacttttattgatataatttaggcatatacaaatactggtgaaattttattgattgaattattgttgacttttttttcagtatttatatttttaaaaagatatgtttctttataattaacttgtattgtagggtaaccattgtccttaaatgttaagccacttagttaataacaaatagcatttggttttttagcattatttatcatctgaggctttcagaattaatgcaccaaaccttaaatatttttgttgttctctaaaagaatgggtttatgatgcaccaaaaggacattttgagaactgccggagcaacagataccaccatgtaaggagtgaattcccatgtttttcacttatatctagaggcctacttatttaggaggtttcctaagtaagtgtatttagttgtaggaccttagagttgcctaggtccattctattctagcatatactcaacatactgccagagcaaatgtaggttgcagattcaggcaaaacacacacacacacacacacaaaaccctgaagagcacaatgagcattattagcacagccaatttaaaatgatgaggtgttaaccacatttgtataaataatagtttctctaaccctgaatcattatcctgcatttttaatgcaatcggttcataaacatcaaagtgaaaacaccaaatttgtaagaggtcaggaccaactggggctctaaatggagagacagctgagagctgtgtccctatgcgtgggtggccttgcagctgttgattcaccctcaggctaccagacagttgcctctttgcatttgcagaaccagacttcaatcttaggtaaaaatgtatccctcccatggacaggacataaacaatagattgacatcagctctgaaaacagtgcagcagccagactcagcagttgccctgaaatactgagaagtaccaagcataacatcaagactgtttctacacaataatatttgtctttgtacagcaacactgggttctcttaagtatattataaatataaaagctcaaagtccaaaaggttcaatgtgatgatatccttctctacaaatgccaggaacaccagggtagattgcatgagacatgactgccgtatcttggtccttactaggattcccaaatatactccttaataaccagtaaagttatatttacactggacattttaagaaataccagtgttcgttgttagatgagagacagcataattttggaatcacaactgagttcagagttcagttttgagtcctactagttttgtttccttgtgtaagtttcttaacctttgtaaggctagcatgtaaatcagatacaataatatatagttcagggtgtaaagattggattaatgtatgcagtgtctatctagcacagtgcctgttatgtagtagcgtgtcaagagatgttctctcttatgcatttggaggattaggtgctgcacctataggtttccattcatttctcatctatgtaattctgagtcttccttttctagatagaattccccccaacaaaaatttaaagtctaacaggtggtaggtgcttattgaggcccagcaattctacttctggaaaccttcctcaggaaaagattctgatgacagaaaatgctgtgtgaacagtattatatagaattgtttttaatagcaagaaattttttaaaacttacaagttcagtgatatgaggacatttacataaactatcgaaccaccagtcttctgtcaattccttttaaaatgatggttgtgaagactgatgaaaacacagtgtcaatgatatgttaactgaaaaagtaagattaaaaacattatggatagtataagtttcttaaatgccaacaatgcatgaggtgaatagaataagacttttttttaaagaatgtaatttttgacagtctgaaaagacaggccttatatttatattgagaaaaatgatcctgacatttaatgagacactaaaacagtttttattttttgcttacttattctgttctagaatccaaactctacatactgtttaatagagcattattgatattagctgtattagatgactgtatgaagagtcctgtttgctagaatcctactttatcttttaagttttgctaattaccctgcaatgaatgttgaacataaaaaatttgactccctttccatgtgtccactgtttccttgtgccttttgattaataaaactttatttttaagtgagaa

SEQ ID NO: 176988 - DNA, 5090 bp, Homo sapiens
  Payload ID: 14727
  Gene Symbol: RRP1B
  Gene Name: ribosomal RNA processing 1B
  Uniprot ID: Q14684
  ENST ID: ENST00000340648
  CDS Start-End: 118-2394
cgccgccgccttctgtgcagtcgcggcccgggcggacggtggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctgaaaatctggaaggggctcttctactgcatgtgggtgcaggatgaaccccttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcgaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaaagcataagaagaaaggaaataaacttttagagaaaactaacttggaaaaggagaaaggaagcagagtcttttgtgtagaggaagaggacagtgaaagcagtcttcaaaagagaagaaggaagaagaagaagaagcaccacctgcagcctgaaaatccaggcccagggggtgcagccccatccctggaacagaaccggggcagggagcccgaggcctctgggctgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctgggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccagctaaacaagacaccatccagctccaagaaagtcacctttgggctgaacagaaacatgactgccgaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttctgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctccaagcccttgcgctcccgtttctctctctctccgtccacgttccagccgagtcactgcctgaccggctccatggcagctccccatcttccctagaggctgcctgcgcatctggagcctgcgctccggctcagcgacctttcctctcaaatgcggaagcgtgcacttacagttcagaccgttctcctgtaagttcattacaaacacgggcggaaggcactcaggctttcgttggagaaacagaaataaggccttcttttgagcagcgattgctggatcattgatctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggcttaatggctgcattagataggatcctcacatcccattcagaaccaaaactgatacagtgaaacaattaaggtgagcaaatagttttaacttttcttttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgacagcaggaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtctagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaacttttgtatgtgttttatcagaatttgctggactatgctggcaaggactttgtttacgatcaaattgtactagtgtctgcagggtttgtcagtactcgtcaaagccaagtccaattaaaaaaaaaagtctttgccctccaa

SEQ ID NO: 176989 - DNA, 1159 bp, Homo sapiens
  Payload ID: 14728
  Gene Symbol: RRP36
  Gene Name: ribosomal RNA processing 36
  Uniprot ID: Q96EU6
  ENST ID: ENST00000244496
  CDS Start-End: 11-790
ctgccagctgatgccgggagctaactaccgcgccggggccggggccggggccggggcccgacgtccccgcggggcccgggaccgcgaggaggacggcgggggcctggagcccgcggccgtggcccgcgacctattgaggggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggcctctggaaatgtcagccaagatccgagtaccatttttacgtcaggttgttcccattagtaaaaaggtagcccgggaccctcgctttgatgatctgtcaggggaatataatcctgaggtgtttgacaaaacataccaattcttgaatgacatccgagcgaaagagaaagagcttgtgaaaaaacagttgaagaagcacctttcaggagaggagcatgagaaactgcagcaactgcttcagcgaatggagcagcaagaaatggcacagcaggaacgaaagcaacagcaggagctgcacctggccctgaagcaagaacgtcgggctcaggcccagcagggccatcggccatacttcctgaaaaaatctgagcagcgccagttggcactagctgagaagttcaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagaggggccaatgaaaaccatggagtctgttcgtgactcccagggctgggacattatgtaggagccacttcataaacattctctttactca

SEQ ID NO: 176990 - DNA, 528 bp, Homo sapiens
  Payload ID: 14728
  Gene Symbol: RRP36
  Gene Name: ribosomal RNA processing 36
  ENST ID: ENST00000607394
  CDS Start-End: 1-90
gaatataatcctgaggtgtttgacaaaacataccaattcttgaatgacatccgagcgaaagagaaagagctaacatttgcagaatgctaaccatgatactcattttccaatgtggagcttgtgaaaaaacagttgaagaagcacctttcaggagaggagcatgagaaactgcagcaactgcttcagcgaatggagcagcaagaaatggcacagcaggaacgaaagcaacagcaggagctgcacctggccctgaagcaagaacgtcgggctcaggcccagcagggccatcggccatacttcctgaaaaaatctgagcagcgccagttggcactagctgagaagttcaaggagctgaaacgcagcaagaaattggagaacttcttgagtcgaaagaggcgacgaaatgcagggaccaaggggagatactggaaacctctgagcttcagctgttggtttttgggttttgtttttgttttattgagatacagttcacttaactatacagtttacccatttaaggtatacagt

SEQ ID NO: 176991 - DNA, 3801 bp, Homo sapiens
  Payload ID: 14729
  Gene Symbol: RRP7A
  Gene Name: ribosomal RNA processing 7 homolog A
  Uniprot ID: Q9Y3A4
  ENST ID: ENST00000323013
  CDS Start-End: 17-859
gctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcccgcccttccttcctccagctggctggagattattagccaggagacagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaaccgctggagaggggagggggtgggtagtgagatgtggccagaggagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccataaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggaggttacagtaagctgagatcttcccactgcactccagcctgagcgacagagtgagactccatctcaaaaaaaaaaaaaaagtgtgactattagctgggcatgatggcatgcgcctgtagtgccacctactcaggtggctgaggtgggaggatcatttgagcccaggagtttgaggctgcagtgagctatgactgagcctgagcaacagaatgagaccctgtctctcaaaaaatgtgggactgtctctggcagttgggtcacctaattgtgcctggccccaagaaggaggggtgggtacttgaggatggtaaagaacctccccaccaaaggtctctgtttcttaaattctgattacatgtgtccccaggcctctagggactgatcactggagcatgaggcctgatagatcctggtggtcacttgttgggcctgggggcagaccaggggtctttcccagtgcatgagaagagatgggtgaggtgggaccagagtgggcgacagtggctggacaccagctgcctgagccccgccttacctctttgagggtggatttcattgtgtctatcatgaacgacagggactccttgtcagagtaattctctcttggatcaaaatatccgtggactgctctggaaagtgaggagttgggggttgttggggttcatcttagaaccgcctcccagcggtgcccccatcctgccctgggttcaggcctctgaggagaaaccaaagcctgggctaccccaactcccacagctgggtcccttgaccctgggttggatttgaggctcagttaatctcagctcacgctcagctggcacaagccaggcgcaagcaagtgctgaaggcacagccttgctggggcgcagggagttcaggacttggtcacagtcagccctgaacagcagagctgggatctgaacaggcgctggagcccacacttgctctgagagagaatttatgtcttcacaatcctcccattgaaagtctacaatcctggccgggtatggtggctcacgcctgtaatcccagcactttgggaggctgaggcgggtggatcacgaggtcaggagatgagaccatcctggctaacatggtgaaaccctgtctgtactaaaaatacaaaaattagccgggcttggtggtgggtgcctgtagtcccagctactccggaggctgaggcaggagaatggcgtgaacccgggaggcggaccttgcagtgagctgagattgcaccactacactccagcctgggcgacagagccagactccatctcaaaaaaaaaaaaaaa

SEQ ID NO: 176992 - DNA, 687 bp, Homo sapiens
  Payload ID: 14729
  Gene Symbol: RRP7A
  Gene Name: ribosomal RNA processing 7 homolog A
  ENST ID: ENST00000416699
  CDS Start-End: 9-170
gtggcaagatggtggcgcgcaggaggaagtgcgccgcgcgggacccggaggaccgtatccccagcccactgggctacgcagcctccagactgttaagagaagctgtgaaggcacaggcagtgggatctgagctggcaggaggggcggaggtgatgctaaggctctcctgaggaagcgaggtttgagctaaacctgagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggtaga

SEQ ID NO: 176993 - DNA, 6560 bp, Homo sapiens
  Payload ID: 14730
  Gene Symbol: RRP8
  Gene Name: ribosomal RNA processing 8, methyltransferase, homolog (yeast)
  Uniprot ID: O43159
  ENST ID: ENST00000254605
  CDS Start-End: 119-1489
ggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaacaagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggcctgcatccctagtggtggctgacttcggctgtggggattgccgcttggcttcaagtatccggaaccctgtgcattgctttgacttggcttctctggaccctagggtcactgtgtgtgacatggcccaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgagaacatggggatatctgtctcatgacacttcaggtgttatgaaaactagatggtttggaattcaaggcatctttaggttttgctcttctttccaactaagaagccacatggccttcctgtcctgccatctccactctgctgtcatctgatctgtctacagatcagcttcctctgctcacccatagcttctgctccttcagcttcagtttgcccaggccttcaaggttgcagacaggcagctgttgctgtttgactctgaggcaactggttgtccaccaacatcttggctcaagacatcagtctgagccaccaacttgagactgtttggttgtccccataccgagcatttctagtggtttatctttcccctctcccctcatctccatttttggaaccatatagcatcaagccactcccaacacctattgtcctgtgggactttgggatgtatatagctgagagcacagattttggaatcaggtagacctggatttaattcttggcctgctacccagaggcacttaaagtcatttaatctctgtatatcacattcctcatttggaaaatggtagaatttttgtcttgcagggtggttgtgtgggttaactggagaaatctgtagccagggctgggaacataggaggtgctcagtaaactagctatgactattatgtgttgtaagccttattgttttttgaagatcttccctaggctggttggaggctgaggggtaaagaatggatttgttgactaaggaagcctctgggagaggctagacctttcaacaggcctgcttcataggctatttaatgacttttaatagattctgagcttctgtccttggaggggtagtgagggagctgggtctctgttcataaacaacttgttgatgccatgtgggcttgggggcattgggctgttcattggcggaagagtctgtccactatctctgccttgcagtggactcagatcagcatgtcctgggaaagctataggcaaggtgctgagggaaggtgagtttgaatgatagattctaggcctcccccaaaaggtatctgccatgtgcccaggtataaagatatggcctcttgtacttgtttccaggaatacctgacagtacccattgggagatcataggttctatgccctgagccagttggatgcctctaataaggggatggaggttttgaaacaggctgtagtccagagggcatgtttggaggctgggctgtgaatcattaggcaggcactacacagtgcctctacacgtactgttctttctgctggatattcatcggactggcagtttgctcatctttccgaacagcctagttgtttcctattctactcccaaagcaaaatcagttcttcatctgtactctcaaagtactatgtgaagagtgctacttcagcttctaaatattgcattgtgattcctttgtgcatttggctgctgttttctcaagccatgtttatctttgtattcccggagcttgtcatttgagatatagccagtgtacttattcacctagggagagataaggaatgacagggtccagttgagtgggatagatgagaacaggggtgttatagaaacccaggtactagggcacaagatgagggcactgttgactagtcatgatggaagaagtaggcagacaggagaacttcattaggtagaattggtgggatgttgaggttggtaagagaggaatctgaagtaagttccaggttgctcaactgtgggtaggctggtgatgccattcaaagtgttggattttaggaagtgggacatgcgtgaaatctgtgctgggggtctgggaatcagcagcctagaggtggtaattaaagtcagaatagatgagatattcagggtaagataatgagaagagaaaatggctcagaatagaactgaggagcatgtcatggatgggtaaaggaaaatgaagcagtgaaggtgatggaagaggagaaggttcacccagagatgtaggagtaaaaccaggagagttaatttttttttttttttttttttaagacagagtcttgctctgtggcccaggctggaatgcggtggcgtgatctcaggtcactgaaacctctgcctgctggttcaagcacttctcctgcctcagactcccgagtagctgggaatacaggcacatgccaccacgcccagctaatttttgtatttttagtagtgacggggtttcaccatgttggccaggctggtctcgaactcctgacctcgagtgatcggcctgcctcggcctcccaaagtgctgggattacaggcatgagccactgtgcccagccagtgttttttttttttttttttttatgggaggatgggcaggttgttagctgtcgagtgctattgagatgagagagaactcagaatgcagtggggtaaggattgctgagtaatgtggagggcctgtttgaggtaaatggcagtggtaagaggttgctccattatgaaagccctcttccagagttcctgatagggccccagaagttcatttctgattgctttgattttttttcaggggagcaggaagccagtttatcatttgagagtgagaataggggagaggaaatatcttccaggcccacagtgcatagaaatacccagtcagggcaaaatgatttatctgtttacctctcctcatcacttgggcccagagcaatcagcagtgattaggtagagaggagccgagcagagggaagagcataccaatcactcctccctttcccagtgcaggctcctagacttagctggggcagagctgggagaggaaaaagggatttaaaactgcaacaggtgcagattattgttacacaggattagacattctaattaattgagattatgtttgttccttaaactgatcacaggactatctattaagaacatcacaacctcgctgcagcttttctccatagcagggagagtacctcccagtgaataaaatttggagggtggtaagagacaagaataaaattgggtttggttatccgtgcctcatgcttgttcagcatccctttgagagttctccaaataaatagttactgcttctgcagttattggtgtgctccagcttctgttcccataatatagtccagtcctaagggaacacagttctaaaagaaacaacatgatcttggcagagacaccgctcagctccaaacccaaccatttatgtaactgcacaaaactctctacagcttttcacagagaccagtaattagaacctttcatcccctggtcatcctccttcccaggtgaattctctgaccagccatctggttttaggatacccaactcctgcagtaactgccttactggtggtctaattgcttctactcgtgtccctaaagcaattaattttccacacagccatgtgatctttttaaaatgtaaatcagcttatgtcacttctctgcttaaaatccttcaatggattctcactgcctcgagaacaaaagacaaacttttcaggccccgtgtgatcttgcccaggcctccgtcaccatcaccatctgcatcttaacccactcctcccctttcacaaaactccagccacacagacttgctttttattcctcaagctttccaaactgtttctactgagagtctttgcacatgctccatcttccttgaatactctttccccagtgagctcattttcatcttcctgaattcataccactattacctttgcttctgtggaagaaactggccagatgctcacccaaatgtcctctttctggacacaggtaaactgcatttcccagctccatgcatctaggcctatgtgagtagttctcaacagtggaaaatgagtggaagtgatgtttcaatactagaccaaggcagttaaagggtggctgagccatttccattattctcttcctccttcctcttcaaggtaaccttgaagcacatgttttgacggtgatggagtcatagcatagaagaagtctgaatacctgagttactatttagggcataatagctacttgaccaaaaacatccatattggactttgaacaagaaaataaacttgattacattctgctagtgagttttgagggtgttttagcagttatcattatatacactggatatatcttctatggtatcctgtccaccttactcttgaccacagtaccctctttgtttccttcagggtgtttcagatatttaattatcttgccagatgccagtcaacactttctttttgtcccatgagtttaaaatcaggggaaaacatgtactcccaataggaagttgagatactcttttttttttaaatccgtcattgtgactgtgaccggaaaaacaaatcccactaaagaatgtcctaaacagatgtttttttttgtcatataacctggagttaggtgatttggcattggttctggagctgaaggatgttagggatgaggtctctgtagttttcttgtctcatggtcacgaaatgaagtgttattgattaagcagggatgccctacttagtattagacttcttggaagtctccttaattgccacagcccctatctttttggcttcgtttcaagggtccttctacattgttaatactctggtataaatacgttccattattccctataacatgactgaaaccaatctaaagtattaacattttaaatatgtttttgggccaagtgcagtggctcttatctgtgatcccagctactaggaaggctgaggtgggaggattgcttgagcccaggaatttcaggctgtagtgagctatgattgtgccactgtactccggcctggataactgagatcctgtctcaataaataaataaaacaatt

SEQ ID NO: 176994 - DNA, 956 bp, Homo sapiens
  Payload ID: 14730
  Gene Symbol: RRP8
  Gene Name: ribosomal RNA processing 8, methyltransferase, homolog (yeast)
  ENST ID: ENST00000530762
  CDS Start-End: 96-332
gtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaaggcctcatccattctctttaggcccactgtcatcccctgttttcctccagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaacaagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttcca

SEQ ID NO: 176995 - DNA, 1989 bp, Homo sapiens
  Payload ID: 14730
  Gene Symbol: RRP8
  Gene Name: ribosomal RNA processing 8, methyltransferase, homolog (yeast)
  ENST ID: ENST00000533907
  CDS Start-End: 103-1023
tttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtcccaaagcctggaagggtagtactacaaatgatccaccaaagcaaagccctgggtccacttcccctaaaccccctcatacattaagccgcaagcagtggcggaaccggcaaaagaacaagagaagatgtaagaacaagtttcagccacctcaggtgccagaccaggccccagctgaggcccccacagagaagacagaggtgtctcctgttcccaggacagacagccatgaggctcgggcaggggctttgcgagcccgcatggcacagcggctggatggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggtgaatgggggtcagggactgtgagaagccatgtggtgggtcagtcataggctcagatcagaccaatatgtgacccttgccttccactctcaggcctgcatccctagtggtggctgacttcggctgtggggattgccgcttggcttcaagtatccggaaccctgtgcattgctttgacttggcttctctggaccctagggtcactgtgtgtgacatggcccaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggtgagggccccaagacatctgtacctgtttttgtctcatgtggccctattcagggtactggtgttcaggaaggaggctttaggcacaggaacagacattttgctccccaacggaagtgggagccctgggaagctttgtgagcagaggcagtacatagagggaggtgttttaaggagttgggatgaggatttggttctcactgggtcttttctgcccctaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaaca

SEQ ID NO: 176996 - DNA, 726 bp, Homo sapiens
  Payload ID: 14730
  Gene Symbol: RRP8
  Gene Name: ribosomal RNA processing 8, methyltransferase, homolog (yeast)
  ENST ID: ENST00000534343
  CDS Start-End: 78-500
gagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaaggttcctctggaggatgagtctgtggatgtggctgtgttttgcctttcactgatgggaaccaacatcagggacttcctagaggaggcaaatagagtactgaagccagggggtctcctgaaagtggctgaggtcagcagccgctttgaggatgttcgaacctttctgcgggctgtgaccaagctaggcttcaagattgtctccaaggacctgaccaacagccatttcttcttgtttgatttccaaaagactgggccccctctggtagggcccaaggctcagctttcaggcctgcagcttcagccatgtctctacaagcgcaggtgacctctggatcttccttgaaaggggaggcagatctcaaactccaggctcagaactgtgaagactgtttccagcctggctgtgagccaagacctggttcctggtggaccctgaggacaaagtgtgataaaacctctggctcagacttgctctactgaaggcttcttggttataagatgcataaagtcactggggctagctaaacaataaagagtttattgtgagaaca

SEQ ID NO: 176997 - DNA, 1578 bp, Homo sapiens
  Payload ID: 14731
  Gene Symbol: RRP9
  Gene Name: ribosomal RNA processing 9, small subunit (SSU) processome component, homolog (yeast)
  Uniprot ID: O43818
  ENST ID: ENST00000232888
  CDS Start-End: 75-1502
aggcggctggggagctgggagggttcagctgccacgtgagttctgcggccgctgctacacgcctggtgggcagcatgtcggcaacagcggctgctcgtaagcggggaaagccggcctctggggccggggctggcgcgggggccggcaagcggcggcgaaaggccgactctgcgggggacaggggcaaatccaagggtggcggcaagatgaatgaggagatctccagcgactctgagagcgagagcctagctccaaggaagcctgaggaggaggaggaggaggagctggaggaaactgcacaggaaaagaagctgcgcttggccaagctctacctagagcagctccgtcagcaagaggaggagaaggctgaggcccgtgcatttgaggaggaccaggtggcggggcgcctgaaggaggatgtgcttgagcagaggggcaggctgcagaagttggtggcaaaagagatccaggccccagcctcagctgacattcgcgttttacgggggcaccagctctctatcacatgtttggtcgtcacccccgatgactcagccatcttctctgctgccaaagactgcagcatcattaagtggagcgtggagagtggacggaagctgcatgtgattcctcgagccaagaagggtgccgagggaaagccccctggccacagcagccacgtcctctgcatggccatctcctccgacggcaagtaccttgcctctggtgaccgcagcaagctcattctcatttgggaggcccagagctgccagcacttgtacaccttcacaggacaccgggatgcagtgtcgggtctggcattccgcagaggcacccaccagctctacagcacatcccacgatcgctccgtgaaggtgtggaatgtggcagagaactcctacgtggagacgctcttcggacaccaggacgctgtggctgcactggatgccttgagccgggagtgctgtgtgacggctgggggccgggatgggactgtacgtgtgtggaagatccccgaggagtcccagcttgtcttctatggccaccagggctccatcgactgcatccacctaatcaatgaggagcacatggtgtccggcgcggacgatggctctgtggccttgtggggtctctccaagaagcgaccacttgccctgcagcgtgaagctcacgggctgcggggagagccaggcctggagcagcccttctggatatcgtcggtggcagccctcctcaacacagaccttgtggccacaggctcccacagctcctgtgtgcggctttggcagtgtggggaaggcttccggcagcttgaccttctctgtgacatccccctggtgggttttatcaacagcctcaagttctccagctctggggacttcctggtggctggggtagggcaggagcacaggcttggccgatggtggagaatcaaagaggctcggaattctgtctgcatcatcccactccgcagggtccctgtacccccagctgctggttcctgacactcttatcctccttatttaagtccttcccaggctatgccccaccctctttgtattaaaagcctcctcttttggg

SEQ ID NO: 176998 - DNA, 1219 bp, Homo sapiens
  Payload ID: 14732
  Gene Symbol: RBFA
  Gene Name: ribosome binding factor A (putative)
  Uniprot ID: Q8N0V3
  ENST ID: ENST00000262197
  CDS Start-End: 31-759
cctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtttccctgactccagacttctcagcctgccgagcgtactggaagacaacgctctctgctgagcagaacgcacacatggaggctgtcctgcagagaagtgccgcgcacatgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaagaaaa

SEQ ID NO: 176999 - DNA, 1407 bp, Homo sapiens
  Payload ID: 14732
  Gene Symbol: RBFA
  Gene Name: ribosome binding factor A (putative)
  Uniprot ID: Q8N0V3
  ENST ID: ENST00000306735
  CDS Start-End: 139-1170
acacgccgcctgccaggcgtgagtcttcctcccgctctgcgccgtcgccccgcccacacgccgccaccctcgcgtcagttgtcgctccgcgcctgcgcccgttgtctccctgctcgctccgggtcccggcgccgcgccatgtgggctgcggcgggcgggctgtggcgctcccgcgcgggtctccgggccctgttccgtagccgcgatgctgcgctatttccaggctgcgagcggggacttcactgctctgctgtctcctgcaagaactggctcaagaaatttgcctcgaaaaccaaaaaaaaggtttggtatgaaagtccttccttgggttctcactcgacttacaaaccatccaagttggaattcctcatgaggagcacctcaaagaaaaccaggaaggaagaccatgcgcgcctgagggccctgaacggcctcctctataaggcactgacagacctgctgtgtacccctgaagtgagtcaggagctgtatgaccttaacgtggagctctccaaggtttccctgactccagacttctcagcctgccgagcgtactggaagacaacgctctctgctgagcagaacgcacacatggaggctgtcctgcagagaagtgccgcgcacatgaggcaccttttgatgtcccagcagaccctgaggaatgtgccaccgatagtgtttgttcaagacaagggaaatgcagctctagctgagcttgatcagttactggcagtcgcagactttggaccccgggatgaaagagacaactttgtacaaaatgatttcagggaccctgatgccccacaaccctgcggcaccacagagccgaccacaagctccagtctgtgtgggatcgatcatgaggcgctcaacaagcagattatggagtacaaaaggaggaaagataaagggctcgggggcctggtgtggcaggggcaggtggctgagctgacaacgcagatgaaaaagggaaggaagagggccaagccccgcctggagcaggacagctccctcaagagttacctgtcaggcgaggaggttgaagatgacctggacctggttggtgccccggagtacgaatgctatgccccggacacagaggagttggaggcagagagaggaggtggcagaacagaggatggccacagctgcggagcaagcagggagtagatggagaggctctgcccatcccacatttgcagggaaaagcattggcacgcaacgcagcatgtggcttcattgaggcagttgatggagttaaaccatctgctcttctgctacttcaacattttctagcttttccgtgtatctaaacacaatttgctacacaagtcactgtttttttttccatgcactgtgtgtaatttaaaaattaaatggccatcttatcacagattctcacaaaaa

SEQ ID NO: 177000 - DNA, 4737 bp, Homo sapiens
  Payload ID: 14733
  Gene Symbol: RRBP1
  Gene Name: ribosome binding protein 1
  ENST ID: ENST00000246043
  CDS Start-End: 1-4233
atggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggccgagggggcccagaatcagggcaagaaggccgagggggcccagaatcagggcaagaaggccgagggggcccagaatcagggcaagaaggccgagggggcccagaatcagggcaagaaggctgagggggctcagaaccagggcaaaaaggccgagggggctcagaaccagggcaaaaaagtagaaggggcccagaaccagggcaagaaggctgagggtgcccagaaccagggcaaaaaggccgagggggcccagaatcagggcaaaaaggccgagggggcccagaaccagggcaagaaggccgagggggcccagaaccagggcaagaaggccgagggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 177001 - DNA, 3727 bp, Homo sapiens
  Payload ID: 14733
  Gene Symbol: RRBP1
  Gene Name: ribosome binding protein 1
  Uniprot ID: Q9P2E9
  ENST ID: ENST00000360807
  CDS Start-End: 290-3223
gaaggcaggaggcggcgatcccggcggagggggccgttcgccagctctgaggcagaaagtgccacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaagggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 177002 - DNA, 3792 bp, Homo sapiens
  Payload ID: 14733
  Gene Symbol: RRBP1
  Gene Name: ribosome binding protein 1
  Uniprot ID: Q9P2E9
  ENST ID: ENST00000377807
  CDS Start-End: 355-3288
cggcgatcccggcggagggggccgttcgccagctctgaggcagaaagtgccacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaagggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 177003 - DNA, 5041 bp, Homo sapiens
  Payload ID: 14733
  Gene Symbol: RRBP1
  Gene Name: ribosome binding protein 1
  ENST ID: ENST00000377813
  CDS Start-End: 305-4537
cacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggccgagggggcccagaatcagggcaagaaggccgagggggcccagaatcagggcaagaaggccgagggggcccagaatcagggcaagaaggccgagggggcccagaatcagggcaagaaggctgagggggctcagaaccagggcaaaaaggccgagggggctcagaaccagggcaaaaaagtagaaggggcccagaaccagggcaagaaggctgagggtgcccagaaccagggcaaaaaggccgagggggcccagaatcagggcaaaaaggccgagggggcccagaaccagggcaagaaggccgagggggcccagaaccagggcaagaaggccgagggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 177004 - DNA, 1191 bp, Homo sapiens
  Payload ID: 14733
  Gene Symbol: RRBP1
  Gene Name: ribosome binding protein 1
  ENST ID: ENST00000398782
  CDS Start-End: 290-1191
gaaggcaggaggcggcgatcccggcggagggggccgttcgccagctctgaggcagaaagtgccacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaa

SEQ ID NO: 177005 - DNA, 2485 bp, Homo sapiens
  Payload ID: 14733
  Gene Symbol: RRBP1
  Gene Name: ribosome binding protein 1
  ENST ID: ENST00000455029
  CDS Start-End: 176-2431
ctctcgctttccctctcgcgtctctggctgcagaaagaagcttccggttctgaggtcctggaggtgccatttccctctctgttgaagcaaaggccggggcagacctcctaggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacaca

SEQ ID NO: 177006 - DNA, 832 bp, Homo sapiens
  Payload ID: 14733
  Gene Symbol: RRBP1
  Gene Name: ribosome binding protein 1
  ENST ID: ENST00000495501
  CDS Start-End: 1-690
cagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctggcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgacca

SEQ ID NO: 177007 - DNA, 2070 bp, Homo sapiens
  Payload ID: 14733
  Gene Symbol: RRBP1
  Gene Name: ribosome binding protein 1
  ENST ID: ENST00000470422
  CDS Start-End: 526-1566
agctttgcggtgattcccaggaagcctgagggttgtatcagatgaggacaactagctagggcaggaggtgaaggatggcctcaggccaccctgtgagagctatagttagactcctagaatcttggccttgtagcccccagtgacctcagagactgtctggctaccatgtggtaaatgaagctgtgaccagagatgtcacctgacttgattgtggtcacacatccagatagaaggtggcctctgggtctccagcttgccttgactcacaactagaggcctcagtggtggtcgtgaggtcaagggtccacatgggtcacgggccctacctgtggataacttggccagccaggaagggcccgcttctcaggtgtgcgtcaggccagagggcgctgcgctcaggctgggtgtccggtggtcagcatccttcatgcacattccaggactctgcttgggggagttaacactccatcagctctgatccaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 177008 - DNA, 3309 bp, Homo sapiens
  Payload ID: 14733
  Gene Symbol: RRBP1
  Gene Name: ribosome binding protein 1
  ENST ID: ENST00000610403
  CDS Start-End: 1-2805
atggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 177009 - DNA, 1706 bp, Homo sapiens
  Payload ID: 14734
  Gene Symbol: RRS1
  Gene Name: ribosome biogenesis regulator homolog
  Uniprot ID: Q15050
  ENST ID: ENST00000320270
  CDS Start-End: 105-1202
gcatcccggcatctgcacgtggttatgctgccggagtttgggccgccactgtaggaaaagtaacttcagctgcagccccaaagcgagtgagccgagccggagccatggagggccagagcgtggaggagctgctcgcaaaggcagagcaggacgaggcagagaagttgcaacgcatcacggtgcacaaggagctggagctgcagtttgacctgggcaacctgctggcgtcggaccggaaccccccgaccgggctgcggtgcgccggacccacgccggaggccgagctacaggccctggcgcgggacaacacgcaactgctcatcaaccagctgtggcagctgcccacggagcgcgtggaagaggcgatagtggcgcggctgccggagcccaccacacgcctgccgcgagagaagcctctgccccgaccgcggccacttacacgctggcagcagttcgcgcgcctcaagggcatccgtcccaagaagaagaccaacctggtgtgggacgaggtgagtggccagtggcggcggcgctggggctaccagcgcgcccgggacgacaccaaagaatggctgattgaggtgcccggcaatgccgaccccttggaggaccagttcgccaagcggattcaggccaagaaggaaagggtggccaagaacgagctgaaccggctgcgtaacctggcccgcgcgcacaagatgcagctgcccagcgcggccggcttgcaccctaccggacaccagagtaaggaggagctgggccgcgccatgcaagtggccaaggtctccaccgcctctgtggggcgctttcaggagcgcctccccaaggagaaggtgccccggggctccggcaagaaaaggaagtttcaaccccttttcggggactttgcagccgagaaaaagaaccagttggagctgcttcgtgtcatgaacagcaagaagcctcagctggatgtgactagggccaccaataagcagatgagggaggaggaccaggaggaggccgccaagaggaggaaaatgagccagaagggcaagagaaagggaggccggcaggggcctgggggcaagaggaaagggggcccgcccagccagggagggaagaggaaagggggcttgggaggcaagatgaattctgggccgcctggcttgggtggcaagagaaaaggaggacagcgcccaggaggaaagaggaggaagtaatagtttctaactgtcggacccgtctgtaaaccaaggactatgaatactaaatgttaagttctaggcaattatacggggactcagaaggacctggccgctgccttcattgagtttaaagggacaggattgcccttccgtcaagaaagtatgtaagtgttggactgcacaaattaatgtttttcccacaaccgagactttggagattaagaacttatttgaggatttaagaattagggaaataatttggtggaaaccgggaatgagttctattcttaaacagcctttttttttctttttaatgttggatatacggcgaggtagagttggccatatttcagagacttagattgacgtatatgtttctgcattatttttacaacaagtttgtgtatcagagcgggagtgcgggggagggaaagaaaacaaacagtttcagaattgaataggcaagtgactgttttaaagattaagtaataaagatgtcttatctagtgtgacttttaa

SEQ ID NO: 177010 - DNA, 1385 bp, Homo sapiens
  Payload ID: 14735
  Gene Symbol: RPF1
  Gene Name: ribosome production factor 1 homolog
  Uniprot ID: Q9H9Y2
  ENST ID: ENST00000370654
  CDS Start-End: 16-1065
aaaggagccaagaccatggcgaaagccggggataagagcagcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtcgcttatgatgaagctacagatgaatttgcttcttacttcaacaaacagacttctcccaagattctcatcacaacatcagatagacctcatgggagaacagtacgactctgtgaacagctctccacagttataccaaactcacatgtttattacagaagaggactggctctgaaaaaaattattccacagtgcatcgcaagagatttcacagacctgattgttattaatgaagatcgtaaaaccccaaatggacttattttgagtcacttgccaaatggcccaactgctcattttaaaatgagcagtgttcgtcttcgtaaagaaattaagagaagaggcaaggaccccacagaacacatacctgaaataattctgaataattttacaacacggctgggtcattcaattggacgtatgtttgcatctctctttcctcataatcctcaatttatcggaaggcaggttgccacattccacaatcaacgggattacatattcttcagatttcacagatacatattcaggagtgaaaagaaagtgggaattcaggaacttggaccacgttttaccttaaaattaaggtctcttcagaaaggaacctttgattctaaatatggagagtatgaatgggtccataagccccgggaaatggatacaagtagaagaaaattccatttataaagtactgagagaatgatattggattttgctgaacaggcctatcttgaactttggtaaattatttttgacagaatactcttttcaaaatggcatttgctgatttcataaacctttcacgtctggacgaattaccaaatgccatgaattgccactgtgtgtttatgtagaaaatacaaataaaagttattttgatggcttaggtttccttaaacttagttctcttgtttttgggtaactgtgaataattaagttggaatcaagattcagattaactttcctatttgcatagaacacatgagaggaataaaatggttggtaaa

SEQ ID NO: 177011 - DNA, 724 bp, Homo sapiens
  Payload ID: 14735
  Gene Symbol: RPF1
  Gene Name: ribosome production factor 1 homolog
  ENST ID: ENST00000370656
  CDS Start-End: 24-413
acggaagcaaaggagccaagaccatggcgaaagccggggataagagcagcagcagcgggaagaaaagtctaaaacggaaagccgctgccgaagaacttcaggaggctgcaggcgctggggatggggcgacggaaaacggggtccaacccccgaaagcggctgcctttccgccaggctttagcatttcggagattaaaaacaaacagcggcgacacttaatgttcacgcggtggaaacagcagcagcggaaggaaaagttggcagctaagaaaaaacttaaaaaagaaagagaggctcttggcgataaggctccaccaaagcctgtacccaagaccattgacaaccagcgagtgtatgatgaaaccacagtagaccctaatgatgaagaggtaatgttagaagtcttaaattagtttgaatgatcacatataattgataaattatatgtttttttgttgatatttaaagtgctggctggccaagttgcataatggactgattcagctaaaatgttggcatattatcttattatttggtgaagactatttcataattgaatttcccaataatgctatagaaaaattctataaaaattctaggtaaacttttacatttgtcatataatccctgaatggtattttggagggttttgtttttgtttttgtttttgattttgttgagacagagtcttgctctgtcgcccatgctggagtgcagtggtgtg

SEQ ID NO: 177012 - DNA, 873 bp, Homo sapiens
  Payload ID: 14736
  Gene Symbol: RPF2
  Gene Name: ribosome production factor 2 homolog
  ENST ID: ENST00000368864
  CDS Start-End: 93-323
acgcgcagcttccggttccgcctgttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgaatgtgttttgttttgaaagctataaattttgttttacagtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaag

SEQ ID NO: 177013 - DNA, 1531 bp, Homo sapiens
  Payload ID: 14736
  Gene Symbol: RPF2
  Gene Name: ribosome production factor 2 homolog
  Uniprot ID: Q9H7B2
  ENST ID: ENST00000441448
  CDS Start-End: 93-1013
acgcgcagcttccggttccgcctgttccggcgcacgtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagagaattatcaagcgtcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttattttgcctgaaatcctactcgttgacatttgagattttaagctttgtggctgaaaatatatagatctctgagaggga

SEQ ID NO: 177014 - DNA, 906 bp, Homo sapiens
  Payload ID: 14736
  Gene Symbol: RPF2
  Gene Name: ribosome production factor 2 homolog
  ENST ID: ENST00000425871
  CDS Start-End: 265-906
aagtgggagccgtgggatgggagggatgtgggattgaagcgttggccgcttttatcctagccagttgaaaaacgtctgacttccgaagtatgagacagatggtatagtggggttaggagcacagccctcggaatccgacagatctgagtgacagtctggcgcgtccacttaaagctttgtgactttggaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtgtatgcactgaaaaaaccatacggtgtactatataaaaagaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaag

SEQ ID NO: 177015 - DNA, 3621 bp, Homo sapiens
  Payload ID: 14736
  Gene Symbol: RPF2
  Gene Name: ribosome production factor 2 homolog
  ENST ID: ENST00000607388
  CDS Start-End: 58-237
gtaatcgccgagggcacgtgcatgccccctggttaagagttgcaggtagcggtagcgatggacactctggatcgagtagtaaagcccaaaacgaaaagagccaagagattccttgagaagagagaaccgaaactcaatgaaaatattaaaaatgccatgctgattaaagggggaaatgcaaatgcaacagtgacaaaagtacttaaagatgtggaaaaatattacaagaccttttgaggatcagacatcactggaattcttttcaaagaagtcagattgttctttattcatgtttggctcccataataagaagcggccaaataatctagtaataggtcgtatgtatgactaccatgtgctggatatgattgaattaggtattgagaattttgtctctctaaaagacattaagaacagtaaatgtcctgagggaacaaaacccatgctgatatttgctggcgatgatttcgatgtaacagaagattatagaagactaaaaagtcttcttattgatttcttcagaggccccacagtatcaaatatccgcctggctggattagagtatgttctgcacttcactgcactgaatgggaagatttactttcgaagctataagttgctgttgaagaaatctggttgcagaacaccacggattgaattggaagagatgggaccctcattggatctggttctgaggaggacacacctggcatcggatgacctttataaattatctatgaaaatgccaaaagctctcaagccaaagaagaagaaaaatatttcccatgatacttttggtacaacttatggaaggattcatatgcagaagcaagacctaagcaaactacaaaccaggaaaatgaaggggttgaagaagcgacctgcagaaaggataacagaagaccacgagaaaaagtcaaaaagaattaaaaaaaattgatggaacttagccagccactactgtttcattgtgttctacttaagagaattatcaagcgtcaatccattcagagtttcttataagatcttattatatatttttataacatgataattttacgatatattattatgaacagtaatatactagtattaagtgtaaagtaagccttttatttgagacattacaccctggtgtgccattttctcttgtgatatcccctgccctccacaaattcttctttctcattgggtggatggatgggtgaggagggatctccataaccattgggatttttttgaatttctggccttagctaaagaaagccacagaaagccggacccgcaggagctgtgtaaacaatctcagtatgaattacctggaaagttaacctcctctcccaacatggatctacattctgatttttattttctacttttattttgcctgaaatcctactcgttgacatttgagattttaagctttgtggctgaaaatatatagatctctgagagggatgtctgctatctgattattgataaattacactactgttgattgttttaagagactctactactaagtagagcccaccccgcttctctgagacgaaacctgtgttttttggttggtttgtttttaagagatggggtcttgttctgtcacctagggtggagtgcagtggcacaatcacagctcactgcagccctgaactcctgggctcaagtaatcctcctgcctgagcctcttacgtagctgggattacaggcatgagccactgagccctactttttttttttaaagcaatgaggtcttgctgtgttgcccaggctggactcaaattcctgggctcaagtgatcctcccacttcaccttcctgagcagccggaactacagatgttggtccactgcacctggcagaaaagaagttttgataggggcagaaatgaaaaaggagaaaacaggtgagttttaaggtgcagggcactttagggtactgggtagccctaggtagctaaaggttgcatgaaggccctgggcgtttgcagatggtgtagaagccagccaaagcctaactacttgttttgaaagtttcttgaagacaggccttgtgcctaggaaaacagaagctttcttcttccttctactagtattgcatacttgtttttctggaatagggtgttaagttccttgattcagtccttgacaaggaatctcctttatacaagtgccagtaatgttgtaaaggtacagacatacgcaaatcataatttgttacatgaagtaccagtgctttcttttttgttgttttttgagacagagtctcgctctgtcgctcaggctggagtgcagtggcgcgatttcagttcactgcaacctccacctcccaggttcaagcattcttctgcctcagcctcccgagtagctgggattacaggcacccaccaccacgcctggctgattttttgtagagacagggtttcacttcaattccatgttagagagctccgtgcctgtgtatacatgcctttatgtaagcttgctcagctacagatcaacaatgctggcactaagcaaaagttcgagcctcagctttaccttctaccctttcccttctcttttgaatccattccttagctttccctagtcctctccggatagctgttactctcctcttgccagaaaaatgaaggagctggtatcatttatactttttgtttgattatacgtttaaccaaagaccatacagtctcgtacctgaatcagacatttgcactttatatctaaatgagaagaaggggctcagataagtcgtttgctgccatctggaggtagatggacaatagctgagaaggggagccatgaaaagaacatcaggagtgatggacgcatagtccttccccaaagcctcgctcatcactggtaggaggcaaagcagtgggtcctcctcaccagccgcttacgggaccctgccatgcctggacccctctatcaggaagacctaccccagcactactggaaaatcagccaatcttaacccaaagatggccatgatttctgtatgtgagacgtcttaagggtgtttttgtttgttttaatcagccctcttgtttgagatttggcaatacatttctgttttctaggtaatttctgtgtctgatggtagaggatctaataagtattggaatgcttcctatttgctgatagaagtaccaaatagtattattgaagtctaacaaagactttttgttgagaacaccttgtagtgttgtactatctggaactcttgagctgccatttatatcactttttgtggagagcacatcttgattttcagttgtccttactttagaatacaacacacataaattggagactatgtattcatttcaatggaggtggtaaattgcctgttttaagttttacttaatgttgggttttggtagatgaggaaagcattttggttatttgttttgttttaaataccaaatttcttatattttttctggaatattaatactattaccaagctattatttcatggaatttgggtttctttttttttgtttttttaaaattaagtgctgtttgttttcttggttattgaacataatccaaagtagagatgttattactcaattcaagaaaagaaagggctaataaaacttaacttcaagtca

SEQ ID NO: 177016 - DNA, 3165 bp, Homo sapiens
  Payload ID: 14737
  Gene Symbol: RPE
  Gene Name: ribulose-5-phosphate-3-epimerase
  Uniprot ID: Q96AT9
  ENST ID: ENST00000354506
  CDS Start-End: 98-697
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttactgtttgtggctcattttaaaactggtgtcttctcttcatgagacacattaattggtaaaactcaaattgagttttcaaagatgtgatagtattaaagtgcaccaatatttgactcaaatttgcttgctttattttgttaggagtaaacagaaagtagcctgtgtttagtcccaaagatagcagtgattttgaataaaggagttttgtgttgcctgg

SEQ ID NO: 177017 - DNA, 2569 bp, Homo sapiens
  Payload ID: 14737
  Gene Symbol: RPE
  Gene Name: ribulose-5-phosphate-3-epimerase
  Uniprot ID: Q96AT9
  ENST ID: ENST00000359429
  CDS Start-End: 98-784
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaa

SEQ ID NO: 177018 - DNA, 737 bp, Homo sapiens
  Payload ID: 14737
  Gene Symbol: RPE
  Gene Name: ribulose-5-phosphate-3-epimerase
  ENST ID: ENST00000408981
  CDS Start-End: 261-737
ggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacggattttgtttgtcttgtaggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgat

SEQ ID NO: 177019 - DNA, 792 bp, Homo sapiens
  Payload ID: 14737
  Gene Symbol: RPE
  Gene Name: ribulose-5-phosphate-3-epimerase
  Uniprot ID: Q96AT9
  ENST ID: ENST00000411934
  CDS Start-End: 140-622
agcggtatggcgtcgggctgcaagattggcccgtccatcctcaacagcgacctggccaatttaggggccgagtgcctccggatgctagactctggggccgattatctgcacctggacgcaccctgctcttcagggagacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattgg

SEQ ID NO: 177020 - DNA, 925 bp, Homo sapiens
  Payload ID: 14737
  Gene Symbol: RPE
  Gene Name: ribulose-5-phosphate-3-epimerase
  ENST ID: ENST00000429907
  CDS Start-End: 225-650
tgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagagccctttggaagatcattaagtttcacggccttggaagtgagaaatttttccaaaatacggaattaaaaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaata

SEQ ID NO: 177021 - DNA, 2130 bp, Homo sapiens
  Payload ID: 14737
  Gene Symbol: RPE
  Gene Name: ribulose-5-phosphate-3-epimerase
  Uniprot ID: Q96AT9
  ENST ID: ENST00000454822
  CDS Start-End: 159-695
actcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaat

SEQ ID NO: 177022 - DNA, 668 bp, Homo sapiens
  Payload ID: 14737
  Gene Symbol: RPE
  Gene Name: ribulose-5-phosphate-3-epimerase
  ENST ID: ENST00000438265
  CDS Start-End: 228-668
acttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagagattggagtgcagtggcgtgatctctgc

SEQ ID NO: 177023 - DNA, 779 bp, Homo sapiens
  Payload ID: 14737
  Gene Symbol: RPE
  Gene Name: ribulose-5-phosphate-3-epimerase
  ENST ID: ENST00000452025
  CDS Start-End: 20-697
gcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagagattggagtgcagtggcgtgatctctgctcactgcaatctctgcctgccgggttcaagcgattctcctgcctcagcctcctgagtagctgggattacaggcaggagctaacatgattgtgtctggcagtgctattatgaggagtgaagaccccagatctgtgatcaatctattaagaaatgtttgctcagaagctgc

SEQ ID NO: 177024 - DNA, 2511 bp, Homo sapiens
  Payload ID: 14737
  Gene Symbol: RPE
  Gene Name: ribulose-5-phosphate-3-epimerase
  Uniprot ID: Q96AT9
  ENST ID: ENST00000429921
  CDS Start-End: 190-726
actcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcaccctgctcttcagggaggtcagttttttacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaa

SEQ ID NO: 177025 - DNA, 796 bp, Homo sapiens
  Payload ID: 14737
  Gene Symbol: RPE
  Gene Name: ribulose-5-phosphate-3-epimerase
  Uniprot ID: Q96AT9
  ENST ID: ENST00000438204
  CDS Start-End: 144-626
gcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattgg

SEQ ID NO: 177026 - DNA, 1128 bp, Homo sapiens
  Payload ID: 14737
  Gene Symbol: RPE
  Gene Name: ribulose-5-phosphate-3-epimerase
  Uniprot ID: Q96AT9
  ENST ID: ENST00000436630
  CDS Start-End: 283-819
aaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaagg

SEQ ID NO: 177027 - DNA, 668 bp, Homo sapiens
  Payload ID: 14737
  Gene Symbol: RPE
  Gene Name: ribulose-5-phosphate-3-epimerase
  ENST ID: ENST00000445268
  CDS Start-End: 144-617
gcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagagattggagtgcagtggcgtgatctctgctcactgcaatctctgcctgccgggttcaagcgattctcctgcctcagcctcctgagtagctgggattacaggcaggagctaacatgattgtgtctggcagtgctattatgaggagtgaagaccccagatctgtgatca

SEQ ID NO: 177028 - DNA, 858 bp, Homo sapiens
  Payload ID: 14737
  Gene Symbol: RPE
  Gene Name: ribulose-5-phosphate-3-epimerase
  ENST ID: ENST00000435437
  CDS Start-End: 6-581
gcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattgg

SEQ ID NO: 177029 - DNA, 426 bp, Homo sapiens
  Payload ID: 14737
  Gene Symbol: RPE
  Gene Name: ribulose-5-phosphate-3-epimerase
  ENST ID: ENST00000438191
  CDS Start-End: 13-195
ggagccagcggtatggcgtcgggctgcaagattggcccgtccatcctcaacagcgacctggccaatttaggggccgagtgcctccggatgctagactctggggccgattatctgcacctggacgcaccctgctcttcagggaggtcagttttttgcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatggg

SEQ ID NO: 177030 - DNA, 546 bp, Homo sapiens
  Payload ID: 14737
  Gene Symbol: RPE
  Gene Name: ribulose-5-phosphate-3-epimerase
  ENST ID: ENST00000453724
  CDS Start-End: 264-546
gggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcaccctgctcttcagggaggtcagttttttgcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaac

SEQ ID NO: 177031 - DNA, 496 bp, Homo sapiens
  Payload ID: 14737
  Gene Symbol: RPE
  Gene Name: ribulose-5-phosphate-3-epimerase
  ENST ID: ENST00000441588
  CDS Start-End: 175-496
gcttttgggagccagcggtatggcgtcgggctgcaagattggcccgtccatcctcaacagcgacctggccaatttaggggccgagtgcctccggatgctagactctggggccgattatctgcacctggacgtaatggacgggcaccctgctcttcagggaggtcagttttttacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatg

SEQ ID NO: 177032 - DNA, 2130 bp, Homo sapiens
  Payload ID: 14738
  Gene Symbol: RPEL1
  Gene Name: ribulose-5-phosphate-3-epimerase-like 1
  Uniprot ID: Q2QD12
  ENST ID: ENST00000441178
  CDS Start-End: 111-797
ctggccaaactgtggttctttggtagaatttcctggttttaaaaaaaaaaaaagtgggctctagtcttgccggggactcgtggggtaacttgttcttgggagccagcggtatggcgtcgggctgcaagattggcccgtccatcctcaacagcgacctggccaatttaggggccaagtgcctccagatgctagactctggggccgattatctgcatctggatgtaatggatgggcattttgttcccaacatcacctttggtcaccctgtggtagaaagccttcgaaagcagctaggccaggaccctttctttgacatgcacatgatggtgtccaagccagaacagtgggtaaagccaatggctgtagcagaagccaatcagtacacctttcatctcgaggctactgagaacccagggactttgattaaagacattcgggagaatgggatgaaggttggccttgccatcaaaccaggaacctcagttgagtatttggcaccatgggctaatcaaatagatatggccttggttatgacagtggaaccggggtttggagagcagaaattcatggaagatatgatgccaaaggttcactggttgaggacccagttcccatctttggatatagagggcgatggtggagtaggttctgacactgtccataagtgtgcagaggcaggagctaacatgactgtatctggcagtgctattatgaggagtgaagaccccagatctgtgatcaacctattaagaaatatttgctcagaagctgctcagaaacgttctcttgatcgatgaaaccataaggagcccaatgtttctgttcatgaaatctcccttttactggaaaacaggaatattgactaccaaatcatcatgaaattgaagctgtactgcttttttgagcagttattcattccagtgattaaaactgattgtgcagaatattctaagaggtcagaaattggtgtgtataactacatttttagtgatgcaatttaatgattagtgagtaagatactgtttttattgagagacttgatttttataaagagtaaaaatacggctgcattaaggttacaaacagaaaagtgtcttaatgcctaaggagggcatattagctacactacaaaaacaaattttgtctgtacttctgaaaagaattttgttgtttctcagctgttttccaaaagcaaaggaagtctttatggcttttttctatttcatgttatttgtgatttgtttataagtttgggtgggatggcataccatattcttggttcttaaaatctatcacttttcaccttacacttaatgtgtaaaaactataaaaacaatgcgtgaaacccaggggttctaaaatacaagcatagattttatcagggtgtttttgtcaaagcaggttattcagtgattcctccccaccattcttaaggacgttaaataatgctgttgtgttagctctgagtagaaaggaaaaagtaaaaacctctgtatggaagtaatattgggttgaattctgactgcccttttctagctggacctttaacaaatcacccagtcttttttgtgtttctctgaagtcatttatacattaaatgtaattataacaactgtggggttgtgttgagaattaagaggtaacactatatatgtaaagtttctagtactagtcccagaatttagaatatgctcaatacaaagtagatagcattatataagtttatatttttgtgagttataaagtactttgatatattctcattaaatctgtaaatcacctctataagtaagtggtaataataaagcagatatttttgtccccatttaaaaaaaaaaaaaagtgttccctaacagtttccagagcacgagctgaagggattgacgggctcctcaaaggctatacacttttcatggccttgtctcttccaggtacagtgctggctacttttacatatatgttgtcaacaaatcctcaggataattctaaggcaattctactgcaaatgagatactatcttaatttacagttgacaaaaactgagtctcaggaaggttgcctgacctgctcaaggtcatatagctagtaagggtgcagtataggttcgaacccacctgcctgattacgtct

SEQ ID NO: 177033 - DNA, 4127 bp, Homo sapiens
  Payload ID: 14739
  Gene Symbol: RIC1
  Gene Name: RIC1 homolog, RAB6A GEF complex partner 1
  Uniprot ID: Q4ADV7
  ENST ID: ENST00000251879
  CDS Start-End: 286-3783
gaggaaggggcggggtcggggcgggcctccgcgctcctcccgccctctctgtgtccctactctccctccccttccctcccccacactcggccccgtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactggtaatgtagacttcatgtcacttgtacaaggagaattgtattttactccgtgtatttacacattttgctattagttgatattcaaggaattattttcattccaaacttaggaatggataaaagccaactttttgtacatgagttggaatgcccactgtttgaccaaagatgtaaataaagtagaacctatgtctctaagtcttgtgaccttgaagtctaattcaaaaatctaatcatacttggattataaagaagttgagaactgcctgaatataaaagctaccatgcttatgttattgtgggaaggagttctggaatcagatagacatggacctcaaagtaagctgacagaactcattccaggggaacagtaaggccaccttctaaactaggagaggacaaactgaaagtgtatatt

SEQ ID NO: 177034 - DNA, 6658 bp, Homo sapiens
  Payload ID: 14739
  Gene Symbol: RIC1
  Gene Name: RIC1 homolog, RAB6A GEF complex partner 1
  Uniprot ID: Q4ADV7
  ENST ID: ENST00000418622
  CDS Start-End: 192-4352
gtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacgggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatctgaaataaaacactgtgctgctgagttcatctcaaacattcttgaaagcagggcaccagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattac

SEQ ID NO: 177035 - DNA, 6774 bp, Homo sapiens
  Payload ID: 14739
  Gene Symbol: RIC1
  Gene Name: RIC1 homolog, RAB6A GEF complex partner 1
  Uniprot ID: Q4ADV7
  ENST ID: ENST00000414202
  CDS Start-End: 192-4463
gtcagcttgggggtgccttcgtcgcgcagccttgcgtcggcccggcccggccaggccagcgggcagatgccccgagctgccgccgccgccgccgccgactcggccggtggcggtgtgggaggtgggcgaccagcccggggccgctgagtgtgacggacgcaactgggggcgccgggggctccgcacggaccatgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacggttttcagctattgataagcttggacagaatattgctgtggttggcaagtttggttttgcacattactctttactcaccaaaaaatggaaactttttggaaacattacccaggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgtaaatagactgctgaatcctgtattaccacggctactaaaaattagtgtgtaaagaatgcattcttcattgtaaacttaaagtattttatgtacttctagaaatgacttaaatttgttttcatacattatgaaaacaactgcatactccttaattgctttaaacacccatccactgtatgtaattctaattaccttataacagtattaagacagcttgtttgtactgtgcaatttgaacaaggaatgcaatgttattttttacaaaaaacaaacttgtttatttttataataacgatgtatttgatgtggaccaaattcgtaccactatctaaaatagcctcttttctcatagtgcagttgtagtttagaaacaaaacttggtcctctctccttgctttttaaagtaaatggctagatttagttgtcttagccaggtttcctttgaagagaaactcaaaaccattttgaaactgcttagttcagaatacatcgaagtatttaaaattactgagttgggtaatttactatcatttactttttacattacaagtgcaataatatttcacaaaatgaaactcccgaatgggtggagtatgtgattattggtacctggtccttctggtgctatttttatttaagtctttgtttcaaaccacctttccctgaatcttaaagataatgttttgcatgtgagtacatgcagcccagcaagaaactaaactgaactctcttctcctatcctagtccattaaggagaagaaccagcattgcttttgtgtttggtgtgaatattcagtcaataaaaatgatttaccattataaagagctgtgatcttttcaagtatctgaaataaaacactgtgctgctgagttcatctcaaacattcttgaaagcagggcaccagtataagttaactgtattcctgtgggttaggccgtgaatgaatcatttcttttatacaatattcttttacaactaatagagataggaggcccccaggcaagaagtttggcaggtttacagaaaatttggtaatttatttgttatataccttaatttttaaaaacccatttttattgtggtgtttggttcacatatcaactgtttaagccataattttagccaatgaatttaaatattcagtataactatttgaggtttactagatgcatttattaataaattatttgctgaaaccaaaacaagtcattgggggtgtgggaataaaatcaacctttgcttgtaattaaagttgctgctatttctgtaatgtgtatttttctccccttggtaaagggcaataaaaccattacacaaa

SEQ ID NO: 177036 - DNA, 564 bp, Homo sapiens
  Payload ID: 14739
  Gene Symbol: RIC1
  Gene Name: RIC1 homolog, RAB6A GEF complex partner 1
  ENST ID: ENST00000490816
  CDS Start-End: 1-444
catgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactggtaagtgctgctttccttaggcttggtgtccttccatgtcttttggtgaatcctgtcctttcacattaaggcctagttatggttcatgtgttacattttatttatttattatatattatttatt

SEQ ID NO: 177037 - DNA, 3998 bp, Homo sapiens
  Payload ID: 14739
  Gene Symbol: RIC1
  Gene Name: RIC1 homolog, RAB6A GEF complex partner 1
  ENST ID: ENST00000545641
  CDS Start-End: 1-3946
tgaatggaggccagatagtaccatgatagctgtatcaacggcaaatggatacatcttgttttttcatattacatctacaagaggggacaagtacctttatgaaccagtgtatcccaaaggaagtccacaaatgaaggggacaccccattttaaggaagaacagtgtgctccagcattaaatttggagatgaggaaaatactggatttacaagcacccatcatgagtttgcagtctgtgttggaagatctcctggttgctacttctgatggacttcttcatcttattcactgggaaggaatgacaaatggaaggaaagccattaatctttgcacagtacccttttcagtagacctgcagtcatctagagtaggttcattcctgggcttcacagacgtacacatcagagacatggaatactgtgccacacttgatgggtttgctgttgtatttaatgatggtaaagttggatttattacaccagtgtcaagtagatttactgcagagcagcttcatggagtttggccacaagatgttgttgacggaacgtgtgtagcagtaaataacaagtatcgactaatggcatttggctgtgtgagtggttctgtgcaggtctatacaatagataacagcactggagccatgctgctatctcataaattagagctaacagcaaaacagtatcctgacatttggaataaaacaggagctgttaaattgatgagatggtctcctgacaatagtgttgtaatagtgacctgggaatacggaggcctttctttatggagtgtttttggagcacagctgatttgtacacttggaggagattttgcttataggtctgatggcaccaaaaaagatccccttaagatcaactctatgagctggggtgcagaaggctatcacctatgggtaatcagcggatttggttctcaaaacactgaaattgagtctgacctcaggagtgtagttaaacagcccagcatcctgttatttcagtttattaagagtgtactcactgtaaacccttgtatgagtaaccaagagcaggtgttgcttcagggtgaggatcgcttgtacttgaactgtggagaggcttcacaaacccagaatcccaggagttcttcaacacactctgagcataagcccagtcgagaaaagagcccatttgcagatggaggtttagagtctcagggattaagcactttacttggacatcggcattggcatgttgtacagatttccagcacctatctagagagcaattggcctatacgggagcaaaatatgatcgtgacaggtggcttagcctggtggaatgattttatggtccttgcgtgttataacataaatgaccgtcaagaagagcttagagtatacttgcgaacatcaaatctggacaatgcctttgctcatgtcaccaaagcacaagcagaaacattactgcttagtgtcttccaggacatggtaatagtatttagagcagactgttcaatatgcctttacagtattgaaagaaaatctgatggtccaaatactactgctggtattcaagttcttcaggaggtttccatgtcacgctacattcctcaccctttcctggtggtatctgtcactctgacatcagtgagtacagagaatggaatcaccttgaaaatgccacagcaggctcgtggtgcagagagcattatgttaaacctggcaggacagctcatcatgatgcagagggacaggtcaggcccacagatccgggagaaggacagtaaccctaataaccaaaggaaacttctgccattctgtcctcctgttgtactagcccagtctgttgaaaatgtctggacaacgtgtcgagcaaataaacagaaacgtcaccttctggaggccctctggctgagctgtggtggtgcagggatgaaagtttggctccctctcttccctagggatcaccgcaagccccattccttcttgtcccagcggatcatgctgcctttccacatcaacatttacccgctagctgttctgtttgaagatgctttagtccttggtgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagaatatggaagtccctgcagtaagtaggcaacatgctacccttctattcaacacagcactagaacaaggcaagtgggacctttgtcgacacatgattcgatttcttaaagccattggctctggagaatctgagacacctccatccacacccacagctcaggaacccagttcaagtggtggatttgagttcttcaggaatcgaagcatcagtttatcccagtcagctgaaaatgttcctgccagtaaattcagtttacagaaaacactaagtatgccatctggtccctctggaaaaagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagct

SEQ ID NO: 177038 - DNA, 2599 bp, Homo sapiens
  Payload ID: 14739
  Gene Symbol: RIC1
  Gene Name: RIC1 homolog, RAB6A GEF complex partner 1
  ENST ID: ENST00000545243
  CDS Start-End: 1-490
tgctgtcaatgacactttgctctatgattctttatatactcggaacaatgctagagaacagctggaggtgctcttccctttctgtgttgtggagagaacctctcagatctacctccaccacattctacgtcaacttctggtcagaaaccttggggagcaagccttgctcttggcccagtcctgtgccacattaccttacttccctcatgtgctggagctcatgctccatgaagtactggaagaagaagctacctcacgggagcccattcccgaccctctgcttcccactgtggcaaaatttatcactgagttccccctcttcctgcagacagttgtccattgtgccaggaagaccgaatatgccctgtggaattacctttttgcagctgttggaaaccctaaggacttgtttgaggagtgtttgatggctcaggatttggacacagctgcctcttaccttattatcttacagatggagcaaagacagtgactgtgctgagaacatgtatattgacatgatgctctggagacatgctcggcgcctcttagaagatgtgaggttaaaggaccttggctgctttgcagcccagctgggctttgaactaattagttggctatgcaaggaacgtacccgagccgcccgggtagacaactttgtaatagccctgaagagactccacaaagatttcctgtggccacttccaatcatcccagcctcttctatcagttctcctttcaaaaatggaaaataccgaactgtgggagagcagctgttaaagtctcaatcagctgacccatttttgaaccttgagatggatgctggcatctccaacatccagcgaagtcagagctggctcagcaacattggccccacccatcatgagatagacacagcttcatcccatggaccacaaatgcaagatgccttcttgtcacctttatctaataaaggtgatgaatgcagtattggttcagccacagacttgactgaaagtagctccatggtggatggcgactggacaatggtggatgaaaatttctctacactcagtttaactcagtcagagctggagcacatttccatggagttggccagtaaagggcctcataaatcccaggtccagcttcggtatttgctacacattttcatggaggcagggtgcctagactggtgcatcgttataggcctgattcttagagaatcctcaataatcaatcagattttggttattacacagtcttcagaggtagatggagagatgttacagaacataaagacagggctccatgcagtggaccgatgggcctctacagactgtcctggatataagccatttttaaacatcattaagccacaactgcagaagctcagtgagataacagaagagcaggtccagccagatgccttccaaccaataactatgggtaagactccagaacagactagcccccgggcagaggagagcaggggctcctccagccatggaagcatcccccagggtgaagttggaagcagcaatatggtcagccggaaagaggaggacacagcccaagcagaggaggaagaaccttttcaggatgggacttacgactgttctgtgtcctaacagtgaggttccatcacaaaggggcagtattaattagcagcagcgtgcagctcagtacgttgtaacatagttggatgatttaacaggagaactcagttcagagactcttcggtaagtattagtagattttaactaattctttcttgtctaagaaatctttttgactccataaaaatgtgatataaagcatctttcataaaaaaattttaagctgcagtgaaaagtaaatattgtacagatgtacatgagaatattttggttttactcaaaggttggtagctcttaaaccacaggaattgttttgccccaggtgagcttactttttcactacttacatcttctcacatttcccggttctgcattatgtccagattgctttttaaaaaataaatgctaaggtgcttgctatagtctgtcaggtacttgagctacctgtttgctcccttggatacagctggactctttaatcagtcctcctgaatagattgctaccctggggcacaatatgtgccagtgtgatggaaacattctccttggctttactagccagtcaaatcccagtccagaattgatggaagctatttacctgtgagttaatgtgcttgttttagcaagcttgattcccattagaccaatgtgggcagaggtctgagggggttcttctcaattttgctgttagataccactaaactattttgtattaaagaacagtatctttttgtgaatactcttgtgtaaatatattcaaaggcactgttcatattttagggcttgtattataatttgcaaggttttaatgctggattctgcatgtctacacatacaaagacagggcttgctcctctgcaaaactgaggaagacaggtttattggcttggtcatgaagtaacagaaatggtcacactgatcatgaaatgcagcaagttttgtgcaaattaacatagtctcttatttattgcttttgtaaattgaataaagatggacttctatgt

SEQ ID NO: 177039 - DNA, 2859 bp, Homo sapiens
  Payload ID: 14740
  Gene Symbol: RIC3
  Gene Name: RIC3 acetylcholine receptor chaperone
  Uniprot ID: Q7Z5B4
  ENST ID: ENST00000309737
  CDS Start-End: 1-1110
atggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgtgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgttt

SEQ ID NO: 177040 - DNA, 5223 bp, Homo sapiens
  Payload ID: 14740
  Gene Symbol: RIC3
  Gene Name: RIC3 acetylcholine receptor chaperone
  Uniprot ID: Q7Z5B4
  ENST ID: ENST00000335425
  CDS Start-End: 55-618
ggttccggttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgtgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgtttagataaattgttttctgtgttatttcccttcgttcactgtgaggggttgattcatgaggagagccctgggttcctggctcaggtttacttttggccttaggataggattcccttattagagataaatactgctgttctcttctagctcattcattcatttagcagtcaattgctcagtgccaggtgctaggaacagaggctcaatctctaccctcagaaaactcagtgtgacgagagagagcctgacagataaaatgaactatgaccctgtaagagggctcaggatcgtgaatcctgcaggcagagaaacatgagccataatctgtccctgcattttctagctgtggaatcttgggtcagctccttaactggtctgagctttggcttcagggtagtaaagggaggggtattaaaggtcctggttaaatgaaatcatcagtgtgtgtaaaacagcattggttctagctcatacatgataaccactcattaagtggtaattatgtttttattataagggctatgctgtaattcagacatgggcccaaaactacaggaaagataaattgtttttgctaaagtattgccaagaaacttcacagtttcttgggaggtgggccttgaggcatgcaaagaacttcttcaggtaggcaaagaagagaggacactcttggcagaaagagttgttgaaaaaagcagtagggtgtgaaaatacatggatgttcaagtattttggtgaggctgttatgtaaagtgttgttggtctttggggaaaattggcttatggaaattcctgccagaagtactaagcccttatggtggttcttcctgccctagctcttggttggtttatatataaggaatatatttgtgtatttatatatcagacatttggatgtacctttcagttatttaggatttagaaaattctttttggattttccagaattattttatccttcggggatgacagttatatgtgtatatacaacccaggatgacaaaatcatgggtccggtttttgttgccagggctgctgtctcttttcttgcggtcttcatttctcacgagggtgctgggaacttgatcagtcccctggccttttggcactgtggcagagtacacaagtcatacctttatggacagttagctcacaaaacaactgcataatctgggatcactcttggtaaatcaggtgggtggtgcagccaggagatcccctttcctggtcacaacaggagcacaaagaaaccattatctccatgactagctccagaagctgggcccagggagtcgtgatgaggagtggaggtgtatttggcctgtagaatcaacggcctttgagaaccatacaatgcaccttatatggcttgggtgatcaaataacttaaggtccaaattcaaacactttggaaaaagggagctttaatataattatgccaaggtgataggcataaactaagactgtcctggacgtagggtcacccctgtctatagccatttaagatttttgaacctgatgactaaacaaacaaaaccctctttcctttttagaatatcctgtatgcgctatttcccaccagaggcagaggccacaggagataggccatggttcaggtaggaaatgctcttggtcacatcagaactctagatctgggggaataaacaaacccgaattattaccacactctcaaagttctcttcaatctggactatttgtattccaaagaaaaatttagtgctttagctattcagcaatattgagaaaaaacatgaacacatttatgactttgccttgaccattgacttttctaaaatgtgcttccttttcctttatttccctttttttatacaaagaaaatagcccaaatttctcctcttaggtcattccttaacctctcagagaaccagtttccccatgaattgggaataatgctctatttacagggctgtttggattaaataagatgctgtttataaagtgtctgtgccagggcaaagcatgtggtaggtgcttggtgacagcatgatccctgtcaccactctgtcaagtccagtgttgctgagatgtcacacctgacaccctctaaggctaccctgattgccaggagtggcccagggcccttctgcagtctccgggtgcctttagttataacctcttgtctgggtcagaccattagctttcatgtctgcttctagctacaactgtagcctcccttccttttgccttcaaatctgccacagctgcccggcaacaaaaaaagattcctaagcatctcgaggtcctgtttaaatgggttagggtccaagcaagccctgagacatcaagtggttgggtcttttatacctttttcatctctacagccctgttctcttcctaaggccaggcccacaggggatactgaggaaccaccagccccttcaggcggcacagcagaccctgaagagaactgctctaacttaagtaccttctgacttcaccatttttccagcctctgggtgtggttctgatgaaccttaaacttgaaaggcacaggccagaggaaggacagtgttgacccacatgtcattggtgaggttatgatctctttgctattatcacctacttacccacctgaggctcctaggaaacaatgaatgaaaggtatagaaaaaaattaggaagtaaacagggcttttttcccctttatgaaaaaagtacacagaagtgttgaaacgattcaagtttaatttgttgatatatgtgtgtacttagacaaacactaaattctacaacatacataatgtcaacatgggaaaataccaagtttgtcattgcacataccaataaataaatacatttgctccagaataccaaag

SEQ ID NO: 177041 - DNA, 2929 bp, Homo sapiens
  Payload ID: 14740
  Gene Symbol: RIC3
  Gene Name: RIC3 acetylcholine receptor chaperone
  Uniprot ID: Q7Z5B4
  ENST ID: ENST00000343202
  CDS Start-End: 67-1173
agcccgtgctccggttccggttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgtgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgtttagataaa

SEQ ID NO: 177042 - DNA, 867 bp, Homo sapiens
  Payload ID: 14740
  Gene Symbol: RIC3
  Gene Name: RIC3 acetylcholine receptor chaperone
  Uniprot ID: Q7Z5B4
  ENST ID: ENST00000425599
  CDS Start-End: 1-867
atggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattagttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtga

SEQ ID NO: 177043 - DNA, 1300 bp, Homo sapiens
  Payload ID: 14740
  Gene Symbol: RIC3
  Gene Name: RIC3 acetylcholine receptor chaperone
  Uniprot ID: Q7Z5B4
  ENST ID: ENST00000419822
  CDS Start-End: 37-423
ggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaaggtaagtagaatcatcctaatcatattacatcaatgaaaatctaatatggcaataaaaatcattgtctacattaaaacttcttatagttcataaaattatttcaaatccatcatctctttaaatcctgcctcctcttcatgaggtacttaggatagccattatttcagtttcacataagaaatgtttactcaatgtttaagtgttttgccccaaaattcacaactaacaaggcagaactaggacttgaacatggatcttttggttcttaatccagtgagtgatacaattcaatgcactcccctgccaaaaaaaaaaaaaaaaaaaaaaaaattaacatctttacaggccgaaaaggaataaagattttctaagaagagcttttattattgggattggcacagtgatttccaaatagccattgtaaggccaaataatgacaccactttatcctgcttgtttctccacaggaatttgagatgctgtttttaatattatctccaataattctcctgagacagaactgtccctcctgaaattaagcctgatatttcctagctctggggagacatgggtgtaggttctttaaagcagacccccagttgagttccacctccaggcaggcctttgcaggcccctggcccctgtactgtgaattagaggcagaagactcactttgccctcctgtctagagtaagcttaaataagatgagttctttctcgcccaggaattctgcaggcagtctgagttgagtctgtaagaatgcccatagggtgccacacatcccttttagatgagcatgagcaaggaagatgacctgtagggagattttttttcccttgtgttagaaatgcttgttctctggtgccataaagaagcagcacttggacgtacatttaatttcctcagcaaggc

SEQ ID NO: 177044 - DNA, 1017 bp, Homo sapiens
  Payload ID: 14740
  Gene Symbol: RIC3
  Gene Name: RIC3 acetylcholine receptor chaperone
  ENST ID: ENST00000531450
  CDS Start-End: 33-1017
ggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagtacccagacagaccatagtgatgtttacgtccattgcctaggagtatttaccactaaatggttggattgtctgatatttctaagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccag

SEQ ID NO: 177045 - DNA, 2023 bp, Homo sapiens
  Payload ID: 14740
  Gene Symbol: RIC3
  Gene Name: RIC3 acetylcholine receptor chaperone
  ENST ID: ENST00000526962
  CDS Start-End: 52-189
tccggttccggttccggctggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctgcctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaaccctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccaatatagcagtgcccaggggtagagaccatgtgttccatactcggatatttgggtctttttgagagagctggggaaagtagcagcaactagattaagactgggaggattttgaccaaactaaaggccttttctccttactgca

SEQ ID NO: 177046 - DNA, 1211 bp, Homo sapiens
  Payload ID: 14740
  Gene Symbol: RIC3
  Gene Name: RIC3 acetylcholine receptor chaperone
  ENST ID: ENST00000528463
  CDS Start-End: 20-151
gcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaagaaaactaagagtgagaactgacaaaaagccattggatttgacggttaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggaggtagtggaagaggtctgatggggcagattattccaatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagt

SEQ ID NO: 177047 - DNA, 2702 bp, Homo sapiens
  Payload ID: 14741
  Gene Symbol: RIC8A
  Gene Name: RIC8 guanine nucleotide exchange factor A
  Uniprot ID: Q9NPQ8
  ENST ID: ENST00000325207
  CDS Start-End: 326-1939
gcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccagggatggccacctccccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 177048 - DNA, 440 bp, Homo sapiens
  Payload ID: 14741
  Gene Symbol: RIC8A
  Gene Name: RIC8 guanine nucleotide exchange factor A
  ENST ID: ENST00000529275
  CDS Start-End: 1-440
atgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgt

SEQ ID NO: 177049 - DNA, 3703 bp, Homo sapiens
  Payload ID: 14741
  Gene Symbol: RIC8A
  Gene Name: RIC8 guanine nucleotide exchange factor A
  Uniprot ID: Q9NPQ8
  ENST ID: ENST00000526104
  CDS Start-End: 1345-2940
gggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcggggccgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 177050 - DNA, 571 bp, Homo sapiens
  Payload ID: 14741
  Gene Symbol: RIC8A
  Gene Name: RIC8 guanine nucleotide exchange factor A
  ENST ID: ENST00000527468
  CDS Start-End: 438-571
gatgcagtgttgcggggagagtgggggtgcacccgttgggtggcaggcgtgtagggatgggggcgagtgccgaccctgccatccgttctgagcagtggctgctgcctgagttagaggccaataggccgcccgcatcagcggacgcggatcctacccctctgtggatttgaattcactagttctctctgcagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggag

SEQ ID NO: 177051 - DNA, 563 bp, Homo sapiens
  Payload ID: 14741
  Gene Symbol: RIC8A
  Gene Name: RIC8 guanine nucleotide exchange factor A
  ENST ID: ENST00000530889
  CDS Start-End: 15-563
ttccccggcgcgccatggagccccgggcggttgcagaagccgtggagacgggtgaggaggatgtgattatggaagctctgcggtcatacaaccaggagttctctctgcagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgc

SEQ ID NO: 177052 - DNA, 2565 bp, Homo sapiens
  Payload ID: 14741
  Gene Symbol: RIC8A
  Gene Name: RIC8 guanine nucleotide exchange factor A
  Uniprot ID: Q9NPQ8
  ENST ID: ENST00000527696
  CDS Start-End: 225-1802
ggcaggtctgggatgcagtgttgcggggagagtgggggtgcacccgttgggtggcaggcgtgtagggatgggggcgagtgccgaccctgccatccgttctgagcagtggctgctgcctgagttagaggccaataggccgcccgcatcagcggacgcggatcctacccctctgtggatttgaattcactagttctctctgcagcactcccagagcttcacgtttgatgatgcccaacaggaggaccggaaggtgggtgctggcccaaggggtaaaggggcagggacgggtggccccaggaagaagggcctggtggagccgctcttctccctgcccacagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 177053 - DNA, 649 bp, Homo sapiens
  Payload ID: 14741
  Gene Symbol: RIC8A
  Gene Name: RIC8 guanine nucleotide exchange factor A
  ENST ID: ENST00000524854
  CDS Start-End: 1-442
cgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccagccccactgcacctttccccaacaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgc

SEQ ID NO: 177054 - DNA, 965 bp, Homo sapiens
  Payload ID: 14741
  Gene Symbol: RIC8A
  Gene Name: RIC8 guanine nucleotide exchange factor A
  ENST ID: ENST00000526982
  CDS Start-End: 56-214
gaactgcggcccggaacggctgaggaagggcccgtcccgccttccccggcgcgccatggagccccgggcggttgcagaagccgtggagacgggtgaggaggatgtgattatggaagctctgcggtcatacaaccaggagtggctgctgcctgagttagaggccaataggccgcccgcatcagcggacgcggatcctacccctctgtggatttgaattcactagttctctctgcagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgagacgctgccctttaccgacacctggggacccttctccggcactgtgtgatgatcgctactgctggagaccgcacagaggagttccacgg

SEQ ID NO: 177055 - DNA, 859 bp, Homo sapiens
  Payload ID: 14741
  Gene Symbol: RIC8A
  Gene Name: RIC8 guanine nucleotide exchange factor A
  ENST ID: ENST00000527728
  CDS Start-End: 1-859
agtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgagcactacccagagtcacctaggaagaccccaggggaccaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggc

SEQ ID NO: 177056 - DNA, 500 bp, Homo sapiens
  Payload ID: 14741
  Gene Symbol: RIC8A
  Gene Name: RIC8 guanine nucleotide exchange factor A
  ENST ID: ENST00000528357
  CDS Start-End: 56-500
gaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacgg

SEQ ID NO: 177057 - DNA, 159 bp, Homo sapiens
  Payload ID: 14741
  Gene Symbol: RIC8A
  Gene Name: RIC8 guanine nucleotide exchange factor A
  ENST ID: ENST00000626818
  CDS Start-End: 1-159
atggagccccgggcggttgcagaagccgtggagacgggtgaggaggatgtgattatggaagctctgcggtcatacaaccaggagtggctgctgcctgagttagaggccaataggccgcccgcatcagcggacgcggatcctacccctctgtggatttga

SEQ ID NO: 177058 - DNA, 3207 bp, Homo sapiens
  Payload ID: 14742
  Gene Symbol: RIC8B
  Gene Name: RIC8 guanine nucleotide exchange factor B
  Uniprot ID: Q9NVN3
  ENST ID: ENST00000355478
  CDS Start-End: 289-1779
gggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaaggcacccgaaatgtgagatttgatggagaacataaagctttgacattaaactagttatagcgttgacagaaaacagaagatcatgcttgccagtaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaacattaatcttatcactggtcatttagaggaaccaatgccaaaccccatagatgaaatgacagaagaacaaaaagaatatgaagccatgaaacttgtcaacatgcttgataaactttccaggagagcagatgtgaaggacctgcaccaggatggtggttagcaacagtggcccgtgccaaagcacttaccaaagtgatgatgactaagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaa

SEQ ID NO: 177059 - DNA, 5135 bp, Homo sapiens
  Payload ID: 14742
  Gene Symbol: RIC8B
  Gene Name: RIC8 guanine nucleotide exchange factor B
  ENST ID: ENST00000392837
  CDS Start-End: 152-1834
cgggcggaggctggcgggttggaggcaggacggagggagggaaagagggaaggaaggaagctgggaaggagcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaacattaatcttatcactggtcatttagaggaaccaatgccaaaccccatagatgaaatgacagaagaacaaaaagaatatgaagccatgaaacttgtcaacatgcttgataaactttccagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggccatctgtgtgtgtttctttatagatacatgggctaaacaatactatttcacagtttatgcttttttaaagtgcttttacatccatggtcccacttctaatagcctttttaaggacaggtagagtacatggagggttactgaaaaggtcatttatccagaagttacctctctggcaaagcaaaaaaatcaggaattacgtcttaaaggcctttcagctgccagaggagatgtcacaaagtttcttgcaacttacttatgggagagatcttcaagaatatcactcttagactctgaactgaaatttgcatacgcttccaacatgttttattagctggctttgaagctcacaaaagaatggcaaagaaagaggctgctagattgaaggcaggcatactgaaagaagaaaaaggccaactgaaaactagatagtgagatgagaagaataaaacttcaagacatagcaaatctgggactgtctacttaccaaaggatactctagttgacccagaaaatgtgtgtacaacagtatggcccgtagactacttcctataatggtgaccctgagtttttttaaaagaagaaattaaatccagaacgctttataaaagggtaggaagaagacaatagatgttagaatttcatccaaaatgtttgagggagaggtgagtgacccaggttttaaccaacagcaaaagaaatgggcaattcataattttagattaagtgaaaagtttagaaaaaatttaagtatttttgttattctacaaatgcatttttaaagtatttttataatttctataatcaaatagctttggcatgcatgtcagcttacctaaatgaagatgtgtttaatgaaatgccatcttaccagctttctttatgcagagtaagtgtttgaacagtcctgtttcagtagctgtgctcttctgctttcagtgagttctgtttcattttgcatttctctgcactgggcactaagctttgtttttgaaaagagagtttgcggggaagaagatgagagtgtcttcatctggcacacagaaagagaactaatatctgttaagtgcttactacatgctgggcttttgatgtatgttatctcatgtaacctcaccttatcgcatatgaaagatcctctccagaaagcttatgaaagttaccccacgtcacagcaaggaagagtccaactctggtggcctgactcccagcaccactccttccttttccccacagcacacctgggcccacactgtgcctccttagggctctgaaatgctgggaacagagtggtgtgaggagggtggtcattctcaggccattttaagcaataactatttcaacagaactagtttaaagaggtttttaagcagggaagtgacctgaagtggaagtatgagtgggaaacttgcatggtcagcactggatttccaatgaagacctggaatccgttaggataggccagggaccaaggctgcaggctggcctctctgcccacaactctcctgaccttggaagcagggtacggaggcgtgtgtcctaaaataaagcatttgagctgctgctacagaggaacaatcaccagatattgtgaccctttcagatgcccagtagtcctgggaggcaggcagggcaggtgttattatcccttctttataaatgaggacacagaatgaggcagtacaagtgactctaaacacccccttagtgccacatcagtctcgccacctcccaggactaggtgtcacctgtattgacctcttcccctctgattataaaagtaatatatgttcattgtggaaagtttggaaaatgcagaaaataaaattaataatttaccccaaatcccaccatcctgagatcatcactgttaatgttttagtgtatttccttcctgtattttttctatgcatatataatttattttactacaagattgggatcatgctgtatttacagatttgtatcctgctttctttaacatattgtgagcattttcccatgtcaataaatattcttcaaaaagtaa

SEQ ID NO: 177060 - DNA, 2440 bp, Homo sapiens
  Payload ID: 14742
  Gene Symbol: RIC8B
  Gene Name: RIC8 guanine nucleotide exchange factor B
  Uniprot ID: Q9NVN3
  ENST ID: ENST00000392839
  CDS Start-End: 107-1669
agggaaggaaggaagctgggaaggagcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaaagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtg

SEQ ID NO: 177061 - DNA, 3389 bp, Homo sapiens
  Payload ID: 14742
  Gene Symbol: RIC8B
  Gene Name: RIC8 guanine nucleotide exchange factor B
  Uniprot ID: Q9NVN3
  ENST ID: ENST00000462949
  CDS Start-End: 33-1643
agagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctcagcctggaacttaatcttgctgcaaagctctgtaacctcctgagaaagtgcaaggaccggaaatttatcaatgacattaagtgctttgacttgcgcttgctcttccttctgtcacttttgcacaccgacatcaggtcacaattgcgctatgagctccagggactaccgctgctaacgcagatcttggaaagtgcctttagcatcaagtggaccgatgagtatgaatcggccatagaccataatggacctcctctctcacctcaggagacagactgtgccattgaggccctcaaagctctcttcaatgtgacggtagacagttggaaggtgcataaagagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaacattaatcttatcactggtcatttagaggaaccaatgccaaaccccatagatgaaatgacagaagaacaaaaagaatatgaagccatgaaacttgtcaacatgcttgataaactttccaggagagcagatgtgaaggacctgcaccaggatggtggttagcaacagtggcccgtgccaaagcacttaccaaagtgatgatgactaagaccctgtcattaattccatgtgtcaatactgccctgtagtacacagagcagacaagaaagaagagcccttgaaaacaagggaatgatttttgagtcgttatcaagctaagtggcaagcgggaagctgaaactcgtatagttgaacattcttggaggcttatctcttccctggccagatgcctgatcagatgagaagcccgccatgatactgtcacagtgcctagaatgggctctttatccagtagacaccactgtactttttgatacgagggcagtcttaacttgtgttaaggcctgtgtgtagcattgaagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattcaatttggc

SEQ ID NO: 177062 - DNA, 3921 bp, Homo sapiens
  Payload ID: 14742
  Gene Symbol: RIC8B
  Gene Name: RIC8 guanine nucleotide exchange factor B
  Uniprot ID: Q9NVN3
  ENST ID: ENST00000470960
  CDS Start-End: 1170-1946
aaaatgaaaaaggctgactctaacaagtattggtgtccctgtagagcaactggtggggtataaattggtataagtactttgaaacactgttcagcagtacctggtaaagattgacatatggatataacctgtgagtcagcatctcctctctagggtgtatacctgtagatatcaaatgacatgtaaaaattgtgttcacatcagcacttttcaagatagccccaagctggaaacaatccaagtgtcatcaggagtacagcagataagtaaattgtggcatattcatacattggaatactatatagcagtgctttcttaacctacctgtaggtgaggaaccagatttttttccctaaaaatctgtcaggatgaaactcttgtgtaatacaatattacatacaacgccaaactgctcaaaagtttctaaatgttcacacataccttctgtactcatggtgttgcaggccagtgatgaacagggtggggaccagcagtggtacacaaacatacttcaaatagcactgctctcaaacaatgacaaagaacagactgcaactacacagagtagtgtgaatgaatctcacaagccaacacaagagtctgtattttatgattccatacgtgtaaagttcagtagcaaccaaaatactaacctgtgacattaacaagttagaattacccttgaggagcagaagatggtcatttgtagggggtatggaaagaattctgggattcttaatcttggcattgcatgatttttatgttggctatatgggtatgctcattttgtcaaaatttagctgtgtgcttatgatttgtgcacttttctgtatgtacattatacttaacatttacattaaaatttattgatgacctattaaacacacaccctctttcctcattaaggtagtagattagtggaggaaacaaagtgtatgcaagtaaacaaatgtgaaattacaaattatgatttcatgagagaaaaaagagtcttctcggagaagatactttagctgaaacctggagtatgcaaaggaaccagcgatgcaaagagcagaggcaaacaatccagggattttggtagttgttttgagtagagaaatagagctaatttagtggatttagagtaaaagaggacattgtagacatcgggtacaacttgggagttgatgttatcaaaactggaaaagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaactccattgaatttgaggagagaagccatctctcaagaggcaaataagcatgatctacatagttaatacatctaccttcccttatactttcttctaaggcctgattttctttgcttgggaagtgcattaatcttatcactggtcatttagaggaaccaatgccaaaccccatagatgaaatgacagaagaacaaaaagaatatgaagccatgaaacttgtcaacatgcttgataaactttccaggagagcagatgtgaaggacctgcaccaggatggtggttagcaacagtggcccgtgccaaagcacttaccaaagtgatgatgactaagaccctgtcattaattccatgtgtcaatactgccctgtagtacacagagcagacaagaaagaagagcccttgaaaacaagggaatgatttttgagtcgttatcaagctaagtggcaagcgggaagctgaaactcgtatagttgaacattcttggaggcttatctcttccctggccagatgcctgatcagatgagaagcccgccatgatactgtcacagtgcctagaatgggctctttatccagtagacaccactgtactttttgatacgagggcagtcttaacttgtgttaaggcctgtgtgtagcattgaagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtccttcccctcacttgtgtgagtggccccttctgaatctctccagcagccagaggcacgtgagaagcagaaagagctggtaaataaagccttgggcaagcgacttcttagatcagaactcaccaaatggaagcctagcagctgctccataaacctagccccattcttcatatcaattttgtataaatatatagaaacacacacacagcctcagacttacaaactgattatactctaaaagtttgtatgtcagttagctaaaacttcagaatacatttctccctataaagagttataaatgatggtttagttctcaggcagctacaaatgcctatttattccctaatgtacctgaacactagtaccatagaactgaaccaccatctgtatcagcgcatggggagtgtgcattctgaggtctaacccggggtgccaggaacacacacatcctccatcccagcatagagaatggggactccctgagtaatgggagttctttcatggcctctgcttggggtgggggagtcagcagcacccatttgtacatataggtcattcatacatcacattttaaattggggactgtgtgtgctggtgtgtgtgtgagttctacgtttctaccatatgtgatcagtttaatagtaactttatttatttaaaaaaaagaaacacaattagttactgttaaactgataaagggtgtttatttttacttttagaattggtcctatgaagaagtagaaagtgagtcatgcactagacagtgggcctagctcatcagtggctaaagttgaaaaggggttggtttcctgtatatatatgtatgtatatacacacgtacatacattcatatatatacatatatacataatgtgcttaaccactgccttttaaaactttaaattaaataaaacattggggttgattc

SEQ ID NO: 177063 - DNA, 829 bp, Homo sapiens
  Payload ID: 14742
  Gene Symbol: RIC8B
  Gene Name: RIC8 guanine nucleotide exchange factor B
  ENST ID: ENST00000548914
  CDS Start-End: 1-829
gagcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagcatagggctactttcaaatttgaatcaacagatgaagataaaagaaagagtgattctcatcagttccgtgtaatggcagctgtccttcgtcattgtttactaatcgtaggtccaactgaagacaaaacagaagagctacacagcaatgcagtcaaccttttaagcaatgttccagtctcttgtttggatgttctcatttgtccgttaacccatgaagaaacagcccaagaggcaacgactctagatgaactgcccagtaataaaacagctgagaaagaaacagttttgaaaaacaataccatggtatacaatggtatgaatatggaggccattcatgttttactgaattttatggagaagagaatagacaagggaagcagctatagagagggtctaactccagttctcagcttattaaccgaatgttcccgagcccatcgaaacatccgaaaatttctcaaagatcaggttttaccaccgttgagggatgtgacaaatcgacctgaagttggctcaactgtgagaaataagctggtgcgcctcatgacacatgttgaccttggagtcaagcaaattgctgctgaattcctttttgtcctttgcaaagagagagtggatagtctgctgaaatacactggctatgggaatgctgcaggactgtt

SEQ ID NO: 177064 - DNA, 534 bp, Homo sapiens
  Payload ID: 14742
  Gene Symbol: RIC8B
  Gene Name: RIC8 guanine nucleotide exchange factor B
  ENST ID: ENST00000550215
  CDS Start-End: 126-251
aggacggagggagggaaagagggaaggaaggaagctgggaaggagcgagcgggggcgcgaggcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagagtgtttatagggtagatggtatcatcctccccattttatagatgaggaaaccgaggtgcaaagagctgaaatcacgcccaaggtcatggacatataatgttcatagggctactttcaaatttgaatcaacagatgaagataaaagaaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatg

SEQ ID NO: 177065 - DNA, 419 bp, Homo sapiens
  Payload ID: 14742
  Gene Symbol: RIC8B
  Gene Name: RIC8 guanine nucleotide exchange factor B
  ENST ID: ENST00000552619
  CDS Start-End: 65-419
gcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagaaactctgtgaaggcatatttaaagtccttataaaggacatcccaacaacatgtcaagtgtcctgcctggaagtactccgcattctctccagagacaaaaaggttttagttcctgtgacaactaaggaaaatatgcagatactgctgcgactagccaagctaaatgagttagatgattctttggagaaagtatcagagttcccagttattgtggagtcattaaaatgtctgtgtaatatagtgttcaacagtcagatggcacagcagctca

SEQ ID NO: 177066 - DNA, 571 bp, Homo sapiens
  Payload ID: 14742
  Gene Symbol: RIC8B
  Gene Name: RIC8 guanine nucleotide exchange factor B
  ENST ID: ENST00000549643
  CDS Start-End: 313-405
gcgtttacctggaggcagcggcttgggcgcgcagagcggccgcggctcccccgcacctgcggccatggatgaggagcgcgccctctacatcgtccgggccggcgaagcaggggctatcgagcgggtcctgagggattacagcgacaagtggatagtctgctgaaatacactggctatgggaatgctgcaggactgttggcggccaggggcctcttggctggaggaagaggagataattggtactcagaggatgaggacacagacactgaagaatacaaaaatgcaaaaccaaaagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttt

SEQ ID NO: 177067 - DNA, 720 bp, Homo sapiens
  Payload ID: 14742
  Gene Symbol: RIC8B
  Gene Name: RIC8 guanine nucleotide exchange factor B
  ENST ID: ENST00000546449
  CDS Start-End: 1-139
cattaatcttatcactggtcatttagaggaaccaatgccaaaccccatagatgaaatgacagaagaacaaaaagaatatgaagccatgaaacttgtcaacatgcttgataaactttccaggggaatccacatattctagaagctgccaacaaataaatatacaaacgtcaagtctgaaataccccagcttccacctgatttaaactatgcctcaaagaagatgcctacttatccggaagtacccagcagatgcccaactgaagagaggagttgcttaaaccaatgggactaaaacctgatgggacaataacgcctttggaggaagcactcaaccagtactctgtcatcgaagagaccagctctgacacagactaaaagcatcacctgctcaactctcaatattgctttatcagcatcttttctctgtagctccaggggaatcttttctctaaaacatttatgcccttgctttggctagaaacacattaactggtttactcattgagaatccagcatatttaagaggtgaccctgtgttttttgtgatattgaggcattcatacagagctgcagttagacggggttacgggggctaaaagcagaaaaaaaattccatttcatcgggatggaactgaaggattttattctataaagcggccctggttgaatctggcaattctttttgccaagatccctagcagaagatttagccatgtcctt

SEQ ID NO: 177068 - DNA, 2722 bp, Homo sapiens
  Payload ID: 14743
  Gene Symbol: RFESD
  Gene Name: Rieske (Fe-S) domain containing
  Uniprot ID: Q8TAC1
  ENST ID: ENST00000311364
  CDS Start-End: 1418-1891
cgggaccagctgcttccggctgggctgcgggcgtggactcctcattccggctgtggccgcgccgctgcggggcctgaggccctcttgggttttggttcagcgttagttaacggttaacccgccaaggcgggcttccgcccaggcacaggagactcaccgagcttgttcaccttgaaacttgggccacacctgagacctgccacctaaggggggtacgcgggtcgtttttaacaagctttcatggcatttgtgccatgaaagctctaaagtatagaagctgctccagggcttccgcagccccggccgtcctggagatactcgcctcctggagtctgtgtcgagaatttgcagcacctggacagccacgtgcagtctcagaactgcaggcggtctttaccgaaatgttaaacacaacttgaagttaggcaggataactgccagagctggatggaccttagaggtgccagctaacgcgctgtgagcgttttctgcggttaggcctgctctaaacatttgacatgtgttaaagcatttatgtgctttacccacacccctatgtggcgggcccttcttaaagtaaaagaaactgcagcacagcgaagttaagcaacttgccccaaatcacgcagaactgggatgcaaacccaggtctagctcactcgtgatcacaattcaacatcatacgatggtgctgatttccagagcagctctgtgactttatataaaattattgggcaagcgttcaattgtaaacattcgtgaacatagctgttgcacattagcgttcctttttttttttaattcaggaccatctttggtgacaaatataaatatcaatactatatatatcaccaatatacatatttgctttgctaaaaggtttctgtgtcttcaggatagtttacttgcaagcctcatgtttttataaaaacgtgggtgctacctgaataaaactaatgcctacccgttggcggttttgtgaagactaatgaactattatattcaaagggtccaagcagtaggcatttactaaaggacagctagttttatctgttattattctgccattcagagagataccaaaactactctctaaggcatttctcttccctgcatgtaaaagcaagggtgtcatacttgagataagcattctgataatgtgtaggcaaagtttccacacttggtaaaagcatcttagtcatggttcaagacgagtgacaagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaacatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcacaactgtttaaaattcacatacatttgagaggtttaagagcacacatacttagtatgatgtaaggattatcatcaggatcaatagaatacattttatcgaatcttctggattaattagaaacctgaaggttataggtttgggatgttctgtttaagaaggataaaaataaatttggagtaaacaaataataggtaaaaattaaggattagtaagaaaaaattttttaatttaaaaaatttaatttttaaaataggaaaaaatccctgtttgatgtagcagacttaattctggaaaagttttagtatatacaaagtaaacagactatataatgaacttccatcactcagctttaacagttatcagcattcttccattcttgttttatttatacctctgtggatttgctacctctcctatttgattgttatttttacatttttaggaaagtttaaatacattgaaatgttcacctctgaactgtgcaaccttcctaaataacagactttttatacttaaaaaatgcctccaaaaatgagataggtttacctgctgaacttgaaaataagaaacttaaccactgttaagtgatctgtgatcaaggcagatcttgaagtaaggaagccagacacagctgctgcccagccatgagagatgtaaagtctcctattcagtgagccaatgttctttgaatgcctatatgaaattttcaaataaagatttttaaaaacg

SEQ ID NO: 177069 - DNA, 2587 bp, Homo sapiens
  Payload ID: 14743
  Gene Symbol: RFESD
  Gene Name: Rieske (Fe-S) domain containing
  Uniprot ID: Q8TAC1
  ENST ID: ENST00000380005
  CDS Start-End: 182-814
ctcgtgcagtagcgtcacgcggaggcggagcgaggactcggggacagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaatatggaattctcttccccaagctgttggcatgtctagttcatttgcattttgggcatttcagctcagctgtcatctcagtgaccagtttttatctgagcatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcacaactgtttaaaattcacatacatttgagaggtttaagagcacacatacttagtatgatgtaaggattatcatcaggatcaatagaatacattttatcgaatcttctggattaattagaaacctgaaggttataggtttgggatgttctgtttaagaaggataaaaataaatttggagtaaacaaataataggtaaaaattaaggattagtaagaaaaaattttttaatttaaaaaatttaatttttaaaataggaaaaaatccctgtttgatgtagcagacttaattctggaaaagttttagtatatacaaagtaaacagactatataatgaacttccatcactcagctttaacagttatcagcattcttccattcttgttttatttatacctctgtggatttgctacctctcctatttgattgttatttttacatttttaggaaagtttaaatacattgaaatgttcacctctgaactgtgcaaccttcctaaataacagactttttatacttaaaaaatgcctccaaaaatgagataggtttacctgctgaacttgaaaataagaaacttaaccactgttaagtgatctgtgatcaaggcagatcttgaagtaaggaagccagacacagctgctgcccagccatgagagatgtaaagtctcctattcagtgagccaatgttctttgaatgcctatatgaaattttcaaataaagatttttaaaaacgttttagaactttgtgaatgtaggcacaactaagtgtctcctataaatattatagagaggagatctagggttttgttccttggagttcccgagcaaggttgatgttcagttggttcaccctggttttatcatgtcagttatttatggtcagtaccattcagttgcaatgatggtcataccgtaccagttgtaatgtatttaaaataacaccccaagcacccaccatgcaaaaatcagcagcacatagtggtgatttttgcatggtcagtgctcatgcaaaaatcaccactatgtgggaccagaaatagctaaaatgagtagatgatgaattcagagtgagaagaactgtcaagattggaacctagtctcaaagcacagtagtatttttaaaggaatagaattaagaatctaaatctaatacttaacattctaaggagccgacctggactctttctcttggttattataaaaatagtaaatgagtaaggtccgtatagtaaagactctgcttacttacctttactacatattattacacttccttttctgttggagtttggatagcatgagtagcacttggtcctcatttctcagacaaccaacgaaccagacttgggctttttatagatactgtttgtggtagcagctacttactaagtacagaaaatgtactatctctcaggaaggtacatcccagtctattctatcatgtgataatccttcaatgcccagtcaggtcttaacacatgtccagaatataaagtgtacagaagaaatcaaagtactttcttcaggcaaaaactagccctggtttgcaggaataattacagaaatattttctcataggagccactggcaataatgagtagtgtgcacttgatttttcattctaaatttgtatctctaaatctagaaataaaaatcatatcatgtactgtcttca

SEQ ID NO: 177070 - DNA, 2788 bp, Homo sapiens
  Payload ID: 14743
  Gene Symbol: RFESD
  Gene Name: Rieske (Fe-S) domain containing
  Uniprot ID: Q8TAC1
  ENST ID: ENST00000458310
  CDS Start-End: 1332-1964
tgcgggcgtggactcctcattccggctgtggccgcgccgctgcggggcctgaggccctcttgggttttggttcagcgttagttaacggttaacccgccaaggcgggcttccgcccaggcacaggagactcaccgagcttgttcaccttgaaacttgggccacacctgagacctgccacctaaggggggtacgcgggtcgtttttaacaagctttcatggcatttgtgccatgaaagctctaaagtatagaagctgctccagggcttccgcagccccggccgtcctggagatactcgcctcctggagtctgtgtcgagaatttgcagcacctggacagccacgtgcagtctcagaactgcaggcggtctttaccgaaatgttaaacacaacttgaagttaggcaggataactgccagagctggatggaccttagaggtgccagctaacgcgctgtgagcgttttctgcggttaggcctgctctaaacatttgacatgtgttaaagcatttatgtgctttacccacacccctatgtggcgggcccttcttaaagtaaaagaaactgcagcacagcgaagttaagcaacttgccccaaatcacgcagaactgggatgcaaacccaggtctagctcactcgtgatcacaattcaacatcatacgatggtgctgatttccagagcagctctgtgactttatataaaattattgggcaagcgttcaattgtaaacattcgtgaacatagctgttgcacattagcgttcctttttttttttaattcaggaccatctttggtgacaaatataaatatcaatactatatatatcaccaatatacatatttgctttgctaaaaggtttctgtgtcttcaggatagtttacttgcaagcctcatgtttttataaaaacgtgggtgctacctgaataaaactaatgcctacccgttggcggttttgtgaagactaatgaactattatattcaaagggtccaagcagtaggcatttactaaaggacagctagttttatctgttattattctgccattcagagagataccaaaactactctctaaggcatttctcttccctgcatgtaaaagcaagggtgtcatacttgagataagcattctgataatgtgtaggcaaagtttccacacttggtaaaagcatcttagtcatggttcaagacgagtgacaagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaatatggaattctcttccccaagctgttggcatgtctagttcatttgcattttgggcatttcagctcagctgtcatctcagtgaccagtttttatctgagcatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcacaactgtttaaaattcacatacatttgagaggtttaagagcacacatacttagtatgatgtaaggattatcatcaggatcaatagaatacattttatcgaatcttctggattaattagaaacctgaaggttataggtttgggatgttctgtttaagaaggataaaaataaatttggagtaaacaaataataggtaaaaattaaggattagtaagaaaaaattttttaatttaaaaaatttaatttttaaaataggaaaaaatccctgtttgatgtagcagacttaattctggaaaagttttagtatatacaaagtaaacagactatataatgaacttccatcactcagctttaacagttatcagcattcttccattcttgttttatttatacctctgtggatttgctacctctcctatttgattgttatttttacatttttaggaaagtttaaatacattgaaatgttcacctctgaactgtgcaaccttcctaaataacagactttttatacttaaaaaatgcctccaaaaatgagataggtttacctgctgaacttgaaaataagaaacttaaccactgttaagtgatctgtgatcaaggcagatcttgaagtaaggaagccagacacagctgctgcccagccatgagagatgtaaagtctcctattcagtgagccaatgttctttgaatgcctatatgaaattttcaaataaagattttt

SEQ ID NO: 177071 - DNA, 615 bp, Homo sapiens
  Payload ID: 14743
  Gene Symbol: RFESD
  Gene Name: Rieske (Fe-S) domain containing
  ENST ID: ENST00000511684
  CDS Start-End: 261-615
gcacgtctggagctctggctcgtgcagtagcgtcacgcggaggcggagcgaggactcggggacagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaacatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaagga

SEQ ID NO: 177072 - DNA, 464 bp, Homo sapiens
  Payload ID: 14743
  Gene Symbol: RFESD
  Gene Name: Rieske (Fe-S) domain containing
  ENST ID: ENST00000513950
  CDS Start-End: 2-184
catgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccgattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaa

SEQ ID NO: 177073 - DNA, 6321 bp, Homo sapiens
  Payload ID: 14744
  Gene Symbol: RIMBP2
  Gene Name: RIMS binding protein 2
  Uniprot ID: O15034
  ENST ID: ENST00000261655
  CDS Start-End: 165-3323
atgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaagattttagggaacccagcctctgcaggacgggtggatcacatgggccggaggtttccccgtggcagcgctggtcctcagaggtcccggcccgtgacagtcccatccatcgacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaatgggcagaaaggccttgtgccctcaaacttcttggaagaagtgcctgatgacgtagaagtctatctttctgatgctccatcccactactctcaagatacgccaatgcgctcaaaggcaaaaaggaagaagagtgttcatttcacaccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagtttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggtttgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttat

SEQ ID NO: 177074 - DNA, 994 bp, Homo sapiens
  Payload ID: 14744
  Gene Symbol: RIMBP2
  Gene Name: RIMS binding protein 2
  ENST ID: ENST00000536632
  CDS Start-End: 524-994
ctttgactaacatacaaacattttaaacgtgggctgtgcttagctttccattttgcagagtgtgtgggtcctgggaaggctccccagcatgggccatcctgcccctggcacggccgcagcccctgccccagcctgtgctctctgaggaggcccccgaggcccagccctgtctcaatgctttcacatgcagtgtggccaggtacagagtgtggctgtggttatgtgcttctccaattcatctgacctagacctcccgatctatttccacctacatgttaagacacaaaaaagacaaaagtcaaggaaccgctgccatcctcactgctttccaaagctgcatttcccgtgcacgctcctcagttaggctcactgccgctctgttcttcacccccacttgctcgcagacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaatgggcagaaaggccttgtgccctcaaacttcttggaagaagtgcctgatgac

SEQ ID NO: 177075 - DNA, 3868 bp, Homo sapiens
  Payload ID: 14744
  Gene Symbol: RIMBP2
  Gene Name: RIMS binding protein 2
  Uniprot ID: O15034
  ENST ID: ENST00000536002
  CDS Start-End: 1328-3265
gtacactgcagttgtctccgaggtgaacctccggagccttggcacagctcgcttctaaagcttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagcctcagaaaaccaacctccagtgtccgcactttaggaagtgtcccatgctttcacagttgacgatgacgttcgttagcactcttggtttcaagcgacagaaaacccaaacaggaaattgtttttgtgcccatcactgaaaatgtggcttcagacatggctagatccagggctcaaatctgctggcctcagacccagtagaatccaaggcctccccgacatcaccaggacttggctgctctctgccctcctctggatcagcttcagccttggtttccctgtggagacccccagccactccagccctgaccctcctggtggcaaagtggctgcagcctcacctcctcccaagccaaagtccaatagaaaggggcttccctctcccgcagcattctcaggcagaggcccattgccctccgtaggccccacaccacccaggtcaccagtcgctgagggttcagactgtgcttggcacaggggaggtccagaccccagccagtccagaggttcttcccaggagaggagctcctgacgctggaggaagaggcctgaggaacaggcctgttacccagaggatccgctatccaggaggctcaggttgaggctaagaaggagcatgaaggcgcagtgcggctgctagagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagatggtctcctaacagagctggaattagattgaaccgaggcctgaagaagacctgtttccacgcctttccccatgtgccacgttctcctcacctatccaggagtgaatcatcaccttccctgcaatctgctcagattacaaacccggaggaaaggctggagcacttgttctctgggtgaaggacccatacccccactggtttttgagatcggcattcagcgctgtcttatggcagccacagccccaggtggccccagagcccttgacatgtggccacctggggctgagtgtgactgaggccctgaatttttacttctataaaattagttccagattagtttacattctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaattt

SEQ ID NO: 177076 - DNA, 552 bp, Homo sapiens
  Payload ID: 14744
  Gene Symbol: RIMBP2
  Gene Name: RIMS binding protein 2
  ENST ID: ENST00000540658
  CDS Start-End: 1-187
gagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaatgggcagaaaggccttgtgccctcaaacttcttggaagaagtgcctgatgacgtagaagtctatctttctgatgctccatcccactactctcaagatacgccaatgcgctcaaaggcaaaaagggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattcca

SEQ ID NO: 177077 - DNA, 3685 bp, Homo sapiens
  Payload ID: 14744
  Gene Symbol: RIMBP2
  Gene Name: RIMS binding protein 2
  Uniprot ID: O15034
  ENST ID: ENST00000535703
  CDS Start-End: 1133-3070
gaaaatgaactgaaggatgccacccagggagagtatctcctgagatcccatcatgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagcctcagaaaaccaacctccagtgtccgcactttaggaagtgtcccatgctttcacagttgacgatgacgttcgttagcactcttggtttcaagcgacagaaaacccaaacaggaaattgtttttgtgcccatcactgaaaatgtggcttcagacatggctagatccagggctcaaatctgctggcctcagacccagtagaatccaaggcctccccgacatcaccaggacttggctgctctctgccctcctctggatcagcttcagccttggtttccctgtggagacccccagccactccagccctgaccctcctggtggcaaagtggctgcagcctcacctcctcccaagccaaagtccaatagaaaggggcttccctctcccgcagcattctcaggcagaggcccattgccctccgtaggccccacaccacccaggtcaccagtcgctgagggttcagactgtgcttggcacaggggaggtccagaccccagccagtccagaggttcttcccaggagaggagctcctgacgctggaggaagaggcctgaggaacaggcctgttacccagaggatccgctatccaggaggctcaggttgaggctaagaaggagcatgaaggcgcagtgcggctgctagagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagatggtctcctaacagagctggaattagattgaaccgaggcctgaagaagacctgtttccacgcctttccccatgtgccacgttctcctcacctatccaggagtgaatcatcaccttccctgcaatctgctcagattacaaacccggaggaaaggctggagcacttgttctctgggtgaaggacccatacccccactggtttttgagatcggcattcagcgctgtcttatggcagccacagccccaggtggccccagagcccttgacatgtggccacctggggctgagtgtgactgaggccctgaatttttacttctataaaattagttccagattagtttacattctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaatttaaaaagcgttaa

SEQ ID NO: 177078 - DNA, 6105 bp, Homo sapiens
  Payload ID: 14745
  Gene Symbol: RIMBP3
  Gene Name: RIMS binding protein 3
  Uniprot ID: Q9UFD9
  ENST ID: ENST00000619918
  CDS Start-End: 486-5405
ccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagaagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcgacagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagcggagaacaagcagctgcggcgtgcaggctgcccctaccaggcagacgagaaggtgaagcggctcaaggtaaagcgcgcggagctgaccgggctcgcgcggcgcctagctgaccgcgcccgcaagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcgcgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgaggatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggagtggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggcgcgggtggaggtgcggctgccacgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccctattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctcccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgtggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggaacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctccctcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatag

SEQ ID NO: 177079 - DNA, 6105 bp, Homo sapiens
  Payload ID: 14746
  Gene Symbol: RIMBP3B
  Gene Name: RIMS binding protein 3B
  Uniprot ID: A6NNM3
  ENST ID: ENST00000620804
  CDS Start-End: 486-5405
ccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagtagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggaggtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctccctcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatag

SEQ ID NO: 177080 - DNA, 5475 bp, Homo sapiens
  Payload ID: 14747
  Gene Symbol: RIMBP3C
  Gene Name: RIMS binding protein 3C
  ENST ID: ENST00000331505
  CDS Start-End: 138-4775
cggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcatcatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctcccgcaccactccatgtgcgtccctccagaagctgtgcgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatag

SEQ ID NO: 177081 - DNA, 5784 bp, Homo sapiens
  Payload ID: 14747
  Gene Symbol: RIMBP3C
  Gene Name: RIMS binding protein 3C
  Uniprot ID: A6NJZ7
  ENST ID: ENST00000433039
  CDS Start-End: 486-5405
ccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagaagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcatcatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatctt

SEQ ID NO: 177082 - DNA, 10988 bp, Homo sapiens
  Payload ID: 14748
  Gene Symbol: RC3H1
  Gene Name: ring finger and CCCH-type domains 1
  Uniprot ID: Q5TC82
  ENST ID: ENST00000258349
  CDS Start-End: 80-3481
caaagattttgattccagtggaatctttgctttagatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggtccctgagcagcagcctattactttgtgtagtggggttgaagacacaaagcattatgaggaagccaagaaatgtgtagaagaattagcattgtacttaaaaccgctcagcagtgctagaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaagttgcagactccagcctcttttgcacagagtgttcaggaactaacaattgctctccagcgaactggagacccagcaaacttgaaccgactaagaccccatttggagctgttagcaaacattgaccctagtccagatgctcctcctcctacttgggaacagctggaaaatgggctggttgctgtgcgtacagtggtacatgggctggttgattatatccagaaccacagcaaaaaaggagcagatcagcagcagcctccacagcatagcaaatacaaaacatacatgtgtcgagatatgaagcagagaggaggatgccctcgtggggccagctgtacatttgcacactcacaggaggaactggaaaaatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaatttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatgaatgtggagagtaaaggaatgagggaccagcgattagatcttcagagaagagcagcagaaaccagtgatgatgacctcatcccatttggagaccgaccaacagtgtctcggtttggtgccatctcacgaacttccaaaactatatatcagggtgctggtccaatgcaggctatggcacctcagggagctcctacaaaatctattaacatttcagattatagtccatatggaacccacggtggctggggagcttctccatattcacctcatcaaaacataccttctcagggacacttcagtgagagggagagaatatctatgtcagaagtggccagtcatggaaaaccccttccatctgctgagagagaacagctacgactagaattgcagcaattgaaccatcagattagccagcagacccagctacgtggactagaggctgttagtaacaggctggtgttgcagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggttttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaaggtgaggctttttttttttccagttttcttatacatttgtcttctttttttaaaaaaaaaaaaaaaaatatatatatatatatatatatatatatatatgtatgctttttcttttttttttggcttttgtttgctttttgacttttacttaaaacccttttacatttccactttaaatgcctattgtttattgggagaaggaaagaaacttttgtatgtctgacagagtcccaagatttttcatttctctgcataacagtaaaaggcaacattattggcctccaaccttctttttttttttttttttttttttttggagagggagtctgcttctgttgcccaggctggagtgcagtgggttgatctcggctcgctacaacctccacctcccgggttcaagcgattctcctgcctcagcctcctgagtagctgggactacaggcacgcgccaccacgtccagctaatttttgtactacaaccttcttataagcagatttggactgatcttctcctttgggtatgtcagatcatcctaaattttagaagcagttgattcactttggaattcagaatgattcttgtattagaagataatttgtgggtattaatttttgtttaagtttaaaataaaagtaaagattcattttggatatcagttgaaaccccttagtaactcagtttctgttattcttgttctcatttcctttaaatacacttgttcttggcttttgccattttgattctgtgaagtaggcaggagcagggattaatttatacagtattcctgttctgaacaaaaccagaaaagtcactgtataaacttgacttaaaatagtatctttctcttttcatgtattttcatttgggggaaaaaaaatctctttaattgtaacctgaattcaagctgtacccctccatggtcctacactctagagctaatctggttgggcagaaaggcagaaggatggtatattgtcccattgtgcctataatgtattttaaattggtcattccaccttacctaatggaaattcttgcagctttcctagtgctcatcagcggttttaggaattcactaacacccccaaaatttgttttttgttttttgctttttttccttttccttttctctgtgatatcatgagcctgtaaggacaaatggcatatttgggcataactgcttgactctgtaactacttttttaaaatcaaaattgaaaaggtattaattgcttctggctttttaatttttttttttagagacaaagatgaaaccagataggaaatacagtttttatgttttctacttactaaaatattagtttcttctaaatattactttatttgtatttcactaaattccaaagcaaaaatcagatatctgagatgaacaattttgaatgggttaaggtaggagtaataagcattgtgttcactcatacataggtgagggaattttatttatagcgagaaatataaaagtattttgacttactcttttttcaaggagtcgctaggaaagggtagaagaactgagaataagacatctagattccatttctggtttatatgtagctcttttgcctaatttatatataattttgtcataagataagtccagtaactgtcctgtcttagataacgtacagaggctgaagtgaccaaagatccattccttattacttttctaattaaaagaagagttagctagatttctagtagtagtattctagatattgataagacattattcctaatgccaactacaaatattcaactactcagaatgtatttaaaaaattgtttggtacagcattaatgttggtgattcctttctcccatcttatttcccttcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaacaaaggtctggttaagaatggtaacctgctgttttctttaaaggagagccaaagacttgtgctttactctgttttggttttgggggaagtagtagccattttgatcatgaaaccttttagtatttgtgagttgattgtactgtgtaagtagatttatctaaagttaactgttaaagttagctagccttataaaatgtaaaagtaatgaaaattcatcagtttctctaagccagtgaatgtcgtcttttgtaatattgtgtataagcatttgtgcccaccccagcttctgctatcactgtggtcaagtcatgggtctgagtaaaagaattcttgagtatgtgactggtgagaaataactaactatagtcagtacatgtacagattgttaaaattcaagacaaaatactttcactaaaaaaaaggattcgtctcagtaaagaagtattcagttgctgtcacttacatacaaatggtggtgggtagcagtctcaccatttttctactctctttttgctcgttttaaataattgagtaaaggttttatttgtaaaatctatctgtaaaaagcacctgtaacgatttatatgtcattgaaaggaatggcccagttactttttaggagagattaataacctacctggaaattaactgcagtgtttacttagattttttccccctaataagagtctaagtgtgttaaatttttaactgatgatatggttacagtgttgcaaggtgatctcttcccctgaaaaatctgcctatccttttaagaaaaattagacctactaaactaaagcaaattttactttcatcattagcacctaaacaagcaagcagtctactactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaagaaaataaggcacaataagggggaagaacttaaacctcaacataatatcgtgtccaaaaatgtgtatttagaaaaataaaatcctgtggagtttgttatcctaatgtttattttatactagataaggtgacttgttttcttgtattgaggtcttactgtttcagatttgtttttgtttctgttctaactctaagcagacagagctcacaagtctttggcatccattttaggttgtacactcagagtcatcttataactggaaactgtcaggtggtcccccaccccagtgagtgtatgaaagagtcaagaaaaagattggaaacaaactattgggtgaataattggttgctctattattattattattattatttgcctttttttaatcaccatttatttgtgtaatctttctccattgattggctgtcattcttataatatctgaactaccccataaaataattctctgacttaaaggcatttagcttttgcttatcgtttttacatcctctattcaactaagacactgtcttgagagttattttttccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtgtttgtggtgtcttccccttgttaccccttctgccctttttctctgactatggtaatttggtctttaggctcatatcagtctccccgagacattctgcagtcattatcacctttttgggtggattttattttgttttattttgttttttttaaaaaaataactttttaacattggtgcatatttgcttgggatagagcttgtgtaatttaccaatcgtattgattgtaagtgattgtgccctgcagaggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaa

SEQ ID NO: 177083 - DNA, 3775 bp, Homo sapiens
  Payload ID: 14748
  Gene Symbol: RC3H1
  Gene Name: ring finger and CCCH-type domains 1
  Uniprot ID: Q5TC82
  ENST ID: ENST00000367694
  CDS Start-End: 88-3465
ctttttttcaaagattttgattccagtggaatctttgctttagatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggtccctgagcagcagcctattactttgtgtagtggggttgaagacacaaagcattatgaggaagccaagaaatgtgtagaagaattagcattgtacttaaaaccgctcagcagtgctagaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaagttgcagactccagcctcttttgcacagagtgttcaggaactaacaattgctctccagcgaactggagacccagcaaacttgaaccgactaagaccccatttggagctgttagcaaacattgaccctagtccagatgctcctcctcctacttgggaacagctggaaaatgggctggttgctgtgcgtacagtggtacatgggctggttgattatatccagaaccacagcaaaaaaggagcagatcagcagcagcctccacagcatagcaaatacaaaacatacatgtgtcgagatatgaagcagagaggaggatgccctcgtggggccagctgtacatttgcacactcacaggaggaactggaaaaatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaatttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatgaatgtggagagtaaaggaatgagggaccagcgattagatcttcagagaagagcagcagaaaccagtgatgatgacctcatcccatttggagaccgaccaacagtgtctcggtttggtgccatctcacgaacttccaaaactatatatcagggtgctggtccaatgcaggctatggcacctcagggagctcctacaaaatctattaacatttcagattatagtccatatggaacccacggtggctggggagcttctccatattcacctcatcaaaacataccttctcagggacacttcagtgagagggagagaatatctatgtcagaagtggccagtcatggaaaaccccttccatctgctgagagagaacagctacgactagaattgcagcaattgaaccatcagattagccagcagacccagctacgtggactagagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaa

SEQ ID NO: 177084 - DNA, 11261 bp, Homo sapiens
  Payload ID: 14748
  Gene Symbol: RC3H1
  Gene Name: ring finger and CCCH-type domains 1
  Uniprot ID: Q5TC82
  ENST ID: ENST00000367696
  CDS Start-End: 353-3754
tggcccctgctgcaggagcagcctcagcagcagcaggtgggaggccggaggcggtgctggcggtggcggcggcagccgtggcccggcggcctgggacagaatcagagtcaacggtggcctcggcggcggcggcggctgccgcggcggtggcgacggccgcggggactcggagctgagaggagctgctgctcggaccagcgcggttatatttcacactatgtgctgactgtatctacagaagatatttaaaaaaaaaaaagataaactttttttcaaagattttgattccagtggaatctttgctttagatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggtccctgagcagcagcctattactttgtgtagtggggttgaagacacaaagcattatgaggaagccaagaaatgtgtagaagaattagcattgtacttaaaaccgctcagcagtgctagaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaagttgcagactccagcctcttttgcacagagtgttcaggaactaacaattgctctccagcgaactggagacccagcaaacttgaaccgactaagaccccatttggagctgttagcaaacattgaccctagtccagatgctcctcctcctacttgggaacagctggaaaatgggctggttgctgtgcgtacagtggtacatgggctggttgattatatccagaaccacagcaaaaaaggagcagatcagcagcagcctccacagcatagcaaatacaaaacatacatgtgtcgagatatgaagcagagaggaggatgccctcgtggggccagctgtacatttgcacactcacaggaggaactggaaaaatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaatttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatgaatgtggagagtaaaggaatgagggaccagcgattagatcttcagagaagagcagcagaaaccagtgatgatgacctcatcccatttggagaccgaccaacagtgtctcggtttggtgccatctcacgaacttccaaaactatatatcagggtgctggtccaatgcaggctatggcacctcagggagctcctacaaaatctattaacatttcagattatagtccatatggaacccacggtggctggggagcttctccatattcacctcatcaaaacataccttctcagggacacttcagtgagagggagagaatatctatgtcagaagtggccagtcatggaaaaccccttccatctgctgagagagaacagctacgactagaattgcagcaattgaaccatcagattagccagcagacccagctacgtggactagaggctgttagtaacaggctggtgttgcagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggttttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaaggtgaggctttttttttttccagttttcttatacatttgtcttctttttttaaaaaaaaaaaaaaaaatatatatatatatatatatatatatatatatgtatgctttttcttttttttttggcttttgtttgctttttgacttttacttaaaacccttttacatttccactttaaatgcctattgtttattgggagaaggaaagaaacttttgtatgtctgacagagtcccaagatttttcatttctctgcataacagtaaaaggcaacattattggcctccaaccttctttttttttttttttttttttttttggagagggagtctgcttctgttgcccaggctggagtgcagtgggttgatctcggctcgctacaacctccacctcccgggttcaagcgattctcctgcctcagcctcctgagtagctgggactacaggcacgcgccaccacgtccagctaatttttgtactacaaccttcttataagcagatttggactgatcttctcctttgggtatgtcagatcatcctaaattttagaagcagttgattcactttggaattcagaatgattcttgtattagaagataatttgtgggtattaatttttgtttaagtttaaaataaaagtaaagattcattttggatatcagttgaaaccccttagtaactcagtttctgttattcttgttctcatttcctttaaatacacttgttcttggcttttgccattttgattctgtgaagtaggcaggagcagggattaatttatacagtattcctgttctgaacaaaaccagaaaagtcactgtataaacttgacttaaaatagtatctttctcttttcatgtattttcatttgggggaaaaaaaatctctttaattgtaacctgaattcaagctgtacccctccatggtcctacactctagagctaatctggttgggcagaaaggcagaaggatggtatattgtcccattgtgcctataatgtattttaaattggtcattccaccttacctaatggaaattcttgcagctttcctagtgctcatcagcggttttaggaattcactaacacccccaaaatttgttttttgttttttgctttttttccttttccttttctctgtgatatcatgagcctgtaaggacaaatggcatatttgggcataactgcttgactctgtaactacttttttaaaatcaaaattgaaaaggtattaattgcttctggctttttaatttttttttttagagacaaagatgaaaccagataggaaatacagtttttatgttttctacttactaaaatattagtttcttctaaatattactttatttgtatttcactaaattccaaagcaaaaatcagatatctgagatgaacaattttgaatgggttaaggtaggagtaataagcattgtgttcactcatacataggtgagggaattttatttatagcgagaaatataaaagtattttgacttactcttttttcaaggagtcgctaggaaagggtagaagaactgagaataagacatctagattccatttctggtttatatgtagctcttttgcctaatttatatataattttgtcataagataagtccagtaactgtcctgtcttagataacgtacagaggctgaagtgaccaaagatccattccttattacttttctaattaaaagaagagttagctagatttctagtagtagtattctagatattgataagacattattcctaatgccaactacaaatattcaactactcagaatgtatttaaaaaattgtttggtacagcattaatgttggtgattcctttctcccatcttatttcccttcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaacaaaggtctggttaagaatggtaacctgctgttttctttaaaggagagccaaagacttgtgctttactctgttttggttttgggggaagtagtagccattttgatcatgaaaccttttagtatttgtgagttgattgtactgtgtaagtagatttatctaaagttaactgttaaagttagctagccttataaaatgtaaaagtaatgaaaattcatcagtttctctaagccagtgaatgtcgtcttttgtaatattgtgtataagcatttgtgcccaccccagcttctgctatcactgtggtcaagtcatgggtctgagtaaaagaattcttgagtatgtgactggtgagaaataactaactatagtcagtacatgtacagattgttaaaattcaagacaaaatactttcactaaaaaaaaggattcgtctcagtaaagaagtattcagttgctgtcacttacatacaaatggtggtgggtagcagtctcaccatttttctactctctttttgctcgttttaaataattgagtaaaggttttatttgtaaaatctatctgtaaaaagcacctgtaacgatttatatgtcattgaaaggaatggcccagttactttttaggagagattaataacctacctggaaattaactgcagtgtttacttagattttttccccctaataagagtctaagtgtgttaaatttttaactgatgatatggttacagtgttgcaaggtgatctcttcccctgaaaaatctgcctatccttttaagaaaaattagacctactaaactaaagcaaattttactttcatcattagcacctaaacaagcaagcagtctactactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaagaaaataaggcacaataagggggaagaacttaaacctcaacataatatcgtgtccaaaaatgtgtatttagaaaaataaaatcctgtggagtttgttatcctaatgtttattttatactagataaggtgacttgttttcttgtattgaggtcttactgtttcagatttgtttttgtttctgttctaactctaagcagacagagctcacaagtctttggcatccattttaggttgtacactcagagtcatcttataactggaaactgtcaggtggtcccccaccccagtgagtgtatgaaagagtcaagaaaaagattggaaacaaactattgggtgaataattggttgctctattattattattattattatttgcctttttttaatcaccatttatttgtgtaatctttctccattgattggctgtcattcttataatatctgaactaccccataaaataattctctgacttaaaggcatttagcttttgcttatcgtttttacatcctctattcaactaagacactgtcttgagagttattttttccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtgtttgtggtgtcttccccttgttaccccttctgccctttttctctgactatggtaatttggtctttaggctcatatcagtctccccgagacattctgcagtcattatcacctttttgggtggattttattttgttttattttgttttttttaaaaaaataactttttaacattggtgcatatttgcttgggatagagcttgtgtaatttaccaatcgtattgattgtaagtgattgtgccctgcagaggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaa

SEQ ID NO: 177085 - DNA, 3081 bp, Homo sapiens
  Payload ID: 14749
  Gene Symbol: RC3H2
  Gene Name: ring finger and CCCH-type domains 2
  ENST ID: ENST00000335387
  CDS Start-End: 174-1694
ctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtgtaacccccgtggactatatcttcattgttgtctcctttcctcagtggctagcttgggcactgtacataatgagctctacaagcagcagcattgtgatagagagaagataagtgtgtgtgcagtgaaaagagcagaaacatgcttctcttctcagtttttttccccacttgaagtgcctagagaagaggattaaggagtcctaaggaaaaaagatgctgtttgtacccaatcgaactagttctatatacagaatttcacatcaagataatttgggagactccaggaaatacattcagcttgtccatacctgaaatagagctttttagctaaaaggggagcttttgagaaagttcgactaaaaaagtcagagaagaaactgtggtttcattgccattccaccctcaattagtgcccaggctgaaaatccattttcttctttctcataccttcaaacagacttcacattcttcatctgcagtacctagttcagaactttattatattttgccagacttgtaatagtagcagtaaaaataataatagccaaactaggtgtagtggctcatgcctgtattcccagcagtttgggaggcaaaggcaggaggataccttgagtccaggagtttgagaccagcctgggcaacatagtgagacctcacctctacaaaaaaataaacaaaattggctgagcatagtggcatacgcctgtcatcttagctactcaggaggctgaggtgggaggattgcttgaactcgggaggtcaggtctgccgtgaactgagattataccactgtattccaacccgggcagcagagcaagactctgtctcaaaaatataaataaataaaaataataaaataataaatatataaaatatcactcattcaaaaataataataatggcaaaattattggtcacatttttagtgtttcacatggtaatccagttggttttactgcttcagtggctttttatccagtatcttcctatatctcaatctgtcttttccatttccactattttctttttaaaatatgtgtgtctcctttaaattcttaattagttcctcagtacatcacagaatctcatcctgattttatcctctagctctactctgccatttgtatactttgtttttaaggtatattcaattaatcactgttgattactatataaatttcttttactcttcttttcacttgtctatattgtttattccatattgtattattttctctctcctctttatctggataactatttctaatcatactcagatattatcttccctccacagacttccctaggcagtgttaattgcatccttcaccatgctgccatagcactccatacatagtagtttaaaaattatggtatagttagctgggtgtggtggcaagcacctgtaatcccagctgctcgggaggctgaggcgggagaatggcttgaacttgggaggcagaggttgcagtgagccgagatggcgccactatactcctgtgtggacgacagagcaagattccgtctcaaaaaaataaatataaataaataaataaaaattatggtatagttataaaa

SEQ ID NO: 177086 - DNA, 3991 bp, Homo sapiens
  Payload ID: 14749
  Gene Symbol: RC3H2
  Gene Name: ring finger and CCCH-type domains 2
  Uniprot ID: Q9HBD1
  ENST ID: ENST00000357244
  CDS Start-End: 242-3817
gtcgcggccttcgccgccgccaacggggctgtccctgtagctcccgatggagtttgaggtcgtgaaacctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatg

SEQ ID NO: 177087 - DNA, 9248 bp, Homo sapiens
  Payload ID: 14749
  Gene Symbol: RC3H2
  Gene Name: ring finger and CCCH-type domains 2
  Uniprot ID: Q9HBD1
  ENST ID: ENST00000373670
  CDS Start-End: 602-4177
agccaagtcttgtcagagatttcctctttcaggtggcaaagctgttttcttcacacttgagtctctacaatattgtttggatcagtagtttccaaagttcattaactcctggccatactttattatgttttggggtactggttatccaagggaaacacttttttaaacaacaaaacaaaaaaaccgcccagcagtccaaagtaatttgtgttcctaaaaatggaatatggaaagttaatttgcttgtttgatgtggtcgttgagaaaaatacataaaagctttgatgtttattatgtgagcaaccaatataaatacagtttagttgaaaggaacactattaaggtattgtttccaggcagaatttcagaaatgtaattaattcagcaaataggttttttaaaaaagacatccaaaggttataaaattatttagaagtattttaggtctgaagctgtaatagttgacttaagcaattaactcttcaaaggtgaatgatgaatatgtggttaattcatacttttgtccatttctagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgttacttcatgttggggtttagtttttcttgttttttgactgttaggttgataagactatgaactgtgtaatagtagaacagtggctaacatttattcatacttaagaacatgaataatttctgccttgctaaaatgtgactgaaatggttttgacttggcatctgaaagtatacaatgtgttcaacaagtcatgcatcagatttgtgggaggtattgtactgaaacctaaatttcagtcaacatttgaaaagaagagctgggcattccttcctggtgatctttacctatagtttatctatctgtttttcttctgtttctttaagattagtttgacttttattattatttttttaattaacttctgtgaagttgtttactctgaaaattgtactggaatattttaagccaagctgatctttcaccaggtgtactgtatgtaagggcttttcctgctagcaagatgcttaaacaggatcatgttattggtcgtctgagctatttagttgttttacaaaaccacagcattgtatcagataagattttgataaaaagttttgtgcacatttccaggggcgggagggttgacatttccctgaaatttcttgattagaatgagtaaatactggtgtttgatacctgtcttaatgaacatgctcataaggtgactgataagttgtaaatatacctgagaaacaaaggggtagttttgatattctggtgtcagtatggaagatcttacacatttatttaatactcaaatgtatgaagatgtttgtttgtagcataacaacagcacagtagccttgacttagtttcctttggttagtactgtaccttttttgccatggccagtgctccccatccctatgaagacattttatttatttcactctgtaacctgaaatgaataggaacaagggttttaaaccatgttacattaacttttctgacattataaattagcctagaatattacaggaacatgattgttatataatttatatcagaacctttctataaatatgtgcttattacatttgaaatgcttccaatgtactttatttgctgtttgtaattccaaaaaggatatgcaaaccagtctgtctatttcatggatatttaatagtgagatcttccatgttgaaggtaatgtatttttttttaagattttaaaattgctattttgttacaaaatagagacctattaacagtttgagagctccttatgtgccctcagggaaagaaccctctgtgcaacagaactacacaaaacatcttcagcacgttctgagggtgaatatatactacataaattgatcttgtgtatttaaccttatctttttaattttaaaattgaaattttgaaacttggttgtgctctgctggagggggttgggataaactgcttagatgtttgcctacttgtccagtgaaattacatttgcatcagtatatgtatatacctgccaaccttattggtatgtctcagaacatttatattaaaataatgcttgtcttgcagcaggtgatcccataaaacaataactccctgttcttaaaaacttactctctttttcactaacaacataggaattgtttctgtgttgagattattctgtgttgcatccattctctatgtagtggtcaccttctgtctgtcatggtgggcttaatgtgaagtaaagccattggttctctgccactttcgaagaaagggcagttcatctgatccttcttcagaatggtacctactgatatcatcgaggaaaatgttacaaatcagacctaggatatgactttttaaaattgaggcatttcccgtcatttggcctttttaccaacaagatgtgatgtacaaatttggaatcaaaggatacaaagcaacaagagaggaaatgtgtaatgtgggtaaccaaactgcatatgttacctattgtctaatcagaaaaaatagtctgaggtctggaaagcaggaaagtggtggttattttctttcattttttgtgtttttgttttttaatttctaagttccattctgaaatccatgtgccgcattcagttactgtggttgtagcatcagtttttttgtggtttcatttcattttatgaattcagaggaagttacatatatattttttctagttggtacctgaacaaagcagattcccttgcctttgctgccacgtcttattttcaatgccatgtgataaaccagtgtcatacatgaaagttgtgcattgtaattttcaaaaaaaagggagttcattaggccagtggcactgatttttccttcccatcatagctatttattctagtaagaggataataaaagaaatttcctatacaagaactgaaattttccatttgtatggatctagtcactttcagatttcaatttgaggttaagtatataaagcacatcccaattttatatgctgccttgagaaaattacaggatgcacggcaatttgtaggaatttcaaatgggatcatttaaacatttgaaaaattattttaaaaaccatctagtttgcttttggattttagacattaaagcctatgttgtcttgttaacaggggtggaatgtataaccatcagattcagcatgtgatttcacctttgaatctgagtatttcttccctatcttctttgagtcatttttggagcagactgtcaccagtattgataactaagcattaaagggaaaagttgcattgcaactatgcattggtttcctggaagaacttttcttttgttttagtgaatgaagaggcttgatgggatcacttactgtaactccttctacataaggaccccttctgcaagcagaacacaaaagaacatgctcaaggagtatcccattttctggataaattgaagaagtttgctagtaatgtctttatactagcgtcttccttgtatccctttgctggcaagggaatacaaggcgtcaagaccacagatcaaaacaccccacatttgagtggagtcttatttttactccaagagcagttattcccttctagtctaaaattggcagttttttcttttttttaataaaatttttaaaatattcccaaaccagtggaacacagacactggctgcacttagtactgccaaaagccaaggtcatttgcacatattccatcaacctgtcgagaattaggcctcactttataacccaaggcatggaagtgcatgcattctcttagctgggcaaacaattatactgtagttgtgatacaacacatgtggcttttatttgtactgcacatatccactgtacagccacttgggagtatcgtggttagcttgcagcaactgctgtctgcatttatactgtttattgcatattcttttccctggaagtgaaagagaaatgtttttcttgttgcattgattacattttataaatttgcttagctggaaagtttgggaaaagaggcctgtttgtcaattgtacaaccgattgtgaagctctagtgtgaatatttttacgtctgtattagacattttctttgcaaatctattgttcgattgaaatgtaaatgaaattaaagatggtgtacacccatcatgtaaaaagcaggcaccatctctaagatggatttaatgctcatttttaaggcatatactcagcttctatttaaaactataatttaaaataattctgtacaatgaaatggggaatatatatgggaataaattctattccatttatttcaatttgaatttccaaattgtaatgtttccctttgtgctataggaataggattaaatgggggaagactaggatttataaggcctgtatatggggggagggcagagatggaacaatgagggttgtgatgatagtgaatagcaaagagtgaattctgtgtgtttttgctgtagcactgaagtgaagagatattagctttggctgttcacaaaatagagcatcatgattttcagtgtttgagagaaaattgatggaaaaagtttgcagtacttgacatgtatttgcatgcacaaaataaaattatttgtccaccttaaaa

SEQ ID NO: 177088 - DNA, 666 bp, Homo sapiens
  Payload ID: 14749
  Gene Symbol: RC3H2
  Gene Name: ring finger and CCCH-type domains 2
  ENST ID: ENST00000398671
  CDS Start-End: 1-336
ttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagaggtaaagaaactgaacctttcggcttcatgcttaatgtatttgttttctgctgctgcatcttggttataccattactgagtgcattttggtgtgcctatctctgatggatgattgattgcttttaaaacttataacagaaataaaattgtaatcccagatttcttaaataattctttaa

SEQ ID NO: 177089 - DNA, 923 bp, Homo sapiens
  Payload ID: 14749
  Gene Symbol: RC3H2
  Gene Name: ring finger and CCCH-type domains 2
  ENST ID: ENST00000454740
  CDS Start-End: 1-566
cttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttagggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaa

SEQ ID NO: 177090 - DNA, 3623 bp, Homo sapiens
  Payload ID: 14749
  Gene Symbol: RC3H2
  Gene Name: ring finger and CCCH-type domains 2
  Uniprot ID: Q9HBD1
  ENST ID: ENST00000423239
  CDS Start-End: 300-3494
ccgtggtgaggaggaggaggaggaggaggcggaggtggagggaggaggaggaggccccgtcgcggccttcgccgccgccaacggggctgtccctgtagctcccgatggagtttgaggtcgtgaaacctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgtaagaacgtttcctcttctaaataaagttggtgtaaacaacactgtcacaaccacagccggaaatgtcatttctgtcataggaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagaggtaaagaaactgaacctttcggcttcatgcttaatgtatttgttttctgctgctgcatcttggttataccattactgagtgcattttggtgtgcctatctctgatggatgattgattgcttttaaaacttataacagaaataaaattgtaatcccagatttcttaaataattctttaactagatcatcgggatttttgtttttttga

SEQ ID NO: 177091 - DNA, 749 bp, Homo sapiens
  Payload ID: 14749
  Gene Symbol: RC3H2
  Gene Name: ring finger and CCCH-type domains 2
  Uniprot ID: Q9HBD1
  ENST ID: ENST00000471874
  CDS Start-End: 26-682
ctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccaggtaagataggttactatcttaccttttttattagctattggggcttgaggatgccaatttctggagctcggtgaatcctgagactcaacccgtctttatatgtacaaatcttgatataattaaagataaatttgtttttgt

SEQ ID NO: 177092 - DNA, 5746 bp, Homo sapiens
  Payload ID: 14749
  Gene Symbol: RC3H2
  Gene Name: ring finger and CCCH-type domains 2
  Uniprot ID: Q9HBD1
  ENST ID: ENST00000498479
  CDS Start-End: 181-1617
gtgaaacctccgccgagctctgccccggcgagacgaggcgcctccgtcgccaagccgcgccgtcgcggggctcccgggagcggcccttagcgaccccgcccgggccccctcagcttacaaaacactacacagcaaaataatgatctgctagactgctaacccgagcatccagcttccacaatgcctgtgcaggcagctcaatggacagaatttctgtcctgtccaatctgctataatgaatttgatgagaatgtgcacaaacccatcagtttaggttgttcacacactgtttgcaagacctgcttgaataaacttcatcgaaaagcttgtccttttgaccagactgccatcaacacagatattgatgtacttcctgtcaacttcgcacttctccagttagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgttactggcattagaagatggttctgccctctcaaggaaagttctggtactttttgttgtgcagagactagaaccaagatttcctcaggcatcaaaaacaagtattggtcatgttgtgcaactactgtatcgagcttcttgttttaaggttaccaaaagagatgaagactcttccctaatgcagctgaaggaggaatttcggagttatgaagcattacgcagagaacatgatgcccaaattgttcatattgccatggaagcaggactccgtatttcacctgaacagtggtcctctcttttgtatggtgatttggctcataaatcacacatgcagtctatcattgataagctacagtctccagagtcatttgcaaagagtgtccaggaattgacaattgttttgcaacgaacaggtgacccagctaacttaaatagactgaggcctcatttagagcttcttgcaaacatagaccctaatccagacgctgtttcaccaacttgggagcagctggaaaatgcaatggtagctgttaaaacagtagttcatggccttgtggacttcatacaaaattatagtagaaaaggccatgagacccctcagcctcagccaaacagcaaatacaagactagcatgtgccgagatttgcgacagcaagggggttgtccacgaggaacaaattgtacatttgcccattctcaggaagagcttgaaaagtatcgattaaggaacaaaaagatcaatgccactgaagtactgaaacaacagggaaaattgttccaagtacaaacggaatttcaaatgcagaaaacagtgtttcccagctaatctcacgtagtactgacagtaccttaagagctctggagaccgtgaagaaagtgggaaaggttggcgctaatggtcagaatgctgctgggccctctgcagattctgtaactgaaaataaaattggttctccacccaagactcctgtaagtaatgtagcagctacctcagctgggccctctaatgttggaacagagctgaattctgtgcctcaaaaatccagcccatttctaactagagtaccagtatatcctccgcattctgaaaacattcagtattttcaagatccaaggactcagataccctttgaagtcccacagtacccacagacaggatactatccaccacctccaacggtaccagctggtgtggctccctgtgttcctcgctttgtgaggtccaataacgttccagagtcctccctcccacctgcttccatgccatatgccgatcattacagtacattttcccctcgagatcgaatgaattcttctccttaccagcctcctcctccgcagccgtatggaccagttcctccagtaccttctggaatgtatgctcctgtgtacgacagcaggcgcatctggcgcccacctatgtaccaacgagatgacattattagaagcaattctttacctccaatggatgtgatgcactcatctgtctatcagacatctttgcgggaaagatataactcattagatggatattattcggtggcttgtcagccaccaagtgagccaaggacaactgtgcctttaccaagggaaccttgtggtcatttgaagaccagttgcgaggagcagataagaagaaagccagatcagtgggcacagtaccacactcagaaagcacctcttgtctcttcaactcttcctgtggcaacacagtcaccaacaccaccttctcctctgttcagtgtagactttcgtgcggatttctcagagagtgtgagtggtacaaaatttgaagaagatcatctttcccattattctccctggtcttgtggcaccataggctcctgtataaatgccattgattcagagcccaaagatgtcattgctaattcaaatgctgtgttaatggacctggacagtggtgatgttaagagaagagtacatttatttgaaacccagagaaggacaaaagaagaagatccaataattccctttagtgatggacccatcatctcaaaatggggtgcgatttccagatcttcccgtacaggttaccataccacagatcctgtccaggccactgcttcccaaggaagtgcgactaagcccatcagtgtatcagattatgtcccttatgtcaatgctgttgattcaaggtggagttcatatggcaacgaggccacatcatcagcacactatgttgaaagggacagattcattgttactgatttatctggtcatagaaagcattccagtactggggaccttttgagccttgaacttcagcaggccaagagcaactcattacttcttcagagagaggccaatgctttggccatgcaacagaagtggaattccctggatgaaggccgtcaccttaccttaaaccttttaagcaaggaaattgaactaagaaatggagagttacagagtgattatacagaagatgcaacagatactaaacctgatagggatatcgagttagagctttcagcacttgatactgatgaacctgatggacaaagtgaaccaattgaagagatcttggacatacagcttggtatcagttctcaaaatgatcagttgctaaatggaatggcagtggaaaatgggcatccagtacagcagcaccaaaaggagccaccaaagcagaagaaacagagtttaggtgaagaccatgtgattctggaggagcaaaaaacaattctgccggtaacttcttgctttagccagccactcccagtgtctattagcaatgcaagttgcctccccatcaccacatctgtcagtgctggcaacctcattctgaaaactcatgttatgtctgaagataaaaacgactttttaaaacctgttgcaaatgggaagatggttaacagctgaaaggaggttcatctttcaaatttgtgaccacaccatggaagcatttacactagctttttatatatataatatatattatataatgtatattttttttaaaaaaaagatattactgggggcatccatttcctgtggactctttgatacttcaagccctcttgcattagcattatgaaaaaaaaaaagaaaatttactttactagggtaacatgttcactttccagaaatgattggaatttggacaacatttaacttaagcttcaagcagctttttatgagtttgtagcaatccggtgcagtaactgagccatttcctattttaaatggcttctatagaaaattaacaactcagttattaaactagcaggatcctacaatgatacatctagtgaaagtagacttagttaacttatttatttctattttatgtttcactgagagaagtttccatctcattccagctgctttatttatctttttcatggaactttgcatggatttctttttctttttttaattttgaagagtggagttagatgttcttaccatagaattttacagggttatatactagcattctttactgcattatatgtaggagtgtggtgcagtgcttttatctgtagcatataatttttttttaattttccatttttcaagagtagtttctgctttgttaatatttatacacaggctacttgttgaagtaattaattaaaaatataaccaagtgcctaagtctttcagctgatgtactagatattaaattctcctaagttatgcagaatcgtttttacaattttgataaattatgcactaatgtaatggcagttttttaaaatgcagatttaagcctgtacattattgaatctgatgacttggcaaaagaatcaggtgctttcagctttcttgagaaaaccctgtatgtagcgtttgcactgactaacaagatggtattgctgggtttttaatttaaactaattaatttggttgttcattgcattatcttggttaaatattgtttattgttacttcatgttggggtttagtttttcttgttttttgactgttaggttgataagactatgaactgtgtaatagtagaacagtggctaacatttattcatacttaagaacatgaataatttctgccttgctaaaatgtgactgaaatggttttgacttggcatctgaaagtatacaatgtgttcaacaagtcatgcatcagatttgtgggaggtattgtactgaaacctaaatttcagtcaacatttgaaaagaagagctgggcattccttcctggtgatctttacctatagtttatctatctgtttttcttctgtttctttaagattagtttgacttttattattatttttttaattaacttctgtgaagttgtttactctgaaaattgtactggaatattttaagccaagctgatctttcaccaggtgtactgtatgtaagggcttttcctgctagcaagatgcttaaacaggatcatgttattggtcgtctgagctatttagttgttttacaaaaccacagcattgtatcagataagattttgataaaaagttttgtgcacatttccaggggcgggagggttgacatttccctgaaatttcttgattagaatgagtaaatactggtgtttgatacctgtcttaatgaacatgctcataaggtgactgataagttgtaaatatacctgagaaacaaaggggtagttttgatattctggtgtcagtatggaagatcttacacatttatttaatactcaaatgtatgaagatgtttgtttgtagcataacaacagcacagtagccttgacttagtttcctttggttagtactgtaccttttttgccatggccagtgctccccatccctatgaagacattttatttatttcactctgtaacctgaaatgaataggaacaagggttttaaaccatgttacattaacttttctgacattataaattagcctagaatattacaggaacatgattgttatataatttatatcagaacctttctataaatatgtgcttattacatttgaaa

SEQ ID NO: 177093 - DNA, 4686 bp, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENST ID: ENST00000324439
  CDS Start-End: 400-1185
gagagagggaggacccgtcacaggtaacgatgcgcccagtgagcgtcctttcctctggggccaaccagcgtctccgcgccgctgccgccaacctcgcgccgaactacgccctgagatttgggcgggtagcgattgggggaaaacaggcaacctaagagttattaccgttagcagcgaagactgcgactaacgtcaacgacggagactgcgtctgccttcgcttccgcctcgtagccccgggaaccggaaatccgtctgccccgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaactgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaattaaatatacctcttacttcaggaacaaagttaacaaatatgtttgatgatccagccgactttgacactgttatctccgtaatagctttaccattaggctaggatgtaaaatgtacatttatcagttgataagtacctattgagcaccagttgtatttccaactttgagctatttgaatcttctttgaataaggaagttagccttttaactagaaagcctaagagttctggcacatttatttcttcttttgttgaaatttattcacctagataaaggcagcagtttgggactcagatctttattttatcccaccttcttgtcttctgtattccactcttcttatgttctttcccttcatctgtttccttggcctggccagagcagcagtgctgatcttcatttgggaaaggatgttcctgggtattaccaattagtatacagataagtaaagactagttttccagatctaatacttttttttgaagtggttttgctctgtcatttaggctagagtgtagtgaagtgatcgtagctcactgcagccttgacttcctgggctgaactgatccttccacctcagcctcctgagtagctgggactacaggtgtgtgccaccatgcccagctaatttttaattgttttgtagaaacaaagtccaggctggtcttgaactcctgggctcaagcatttctcctacctcggccttccaagggctaggattacaggcatgagccactgtgcttggtccagatgtattactttttatgtttggtattattctgccaaaccaatcatgttattgtttttaatcattgaatcattggatctttaaataggagtgagtatataataataaggctcttctgttttcaacatctgtgctgggtcatgcattagcattaattactacaatgattctgtggggtaagtgttgtcctcatagacaagaaagctgaggtttagaggttaaaatgacacattgggggtaaataacagacactatatgttggagttgggaatcagatccaagtttgactccaaacccacttttaccacattgcttttgatctaaacttctattttgctaaaatacccctcacagctagtcatccatatcattgaagcgctcatgatttgatagattaacctttcatttttttaggtgactctagttagaaagtcttatttcacaatctgattgtttctttaacttaggatccaaacatgtccaaaataatgcagagtacatatgcaatcactcgtttatgctgtctagtcatgcacttaaagcaattttcaaatgtactcaaagtctctaggcttcggtacccagggttgcttcaagtatttgttcatgacacgtcaactcgatgattaaaatccttcaacacttctcattcacaataagaataaaatctacatcccttaccattcagtatgcaaaacttaaaatacataactttacccttaaatattttttctttctctgacttcataagtataggttatacctctataagaaagaaggtaaaaaactctcaacaatcccttctttcagagagaactactgttaacattttaacagacaacttcattcttttcctattcttttttataatgcttacaggaatgttaaatacttagacagatcttaagtacactagaattatctgtccctgaaataagttaggttgccctgccgcagaatttgtatctatagtttatttggattatttttgaaaaaagtaaaataacaatacccttacgaattttttggtgcatagcatctcagcttcttttatcattaaagatgtatgtataaaaaaaaaatgagtgtatatcaagttgttcatttcttagtttctggggtcttcttaaccagtacatagaactctttatgaattaactttagcttatgttggaagtagtagtttgtttatagtgtcatggattttaaaatcaaactcagtttttatttcttcactaaaacctattttcatatgatatacatgttaaatttcccttttattttggtcatgcatcaaaataaatttactaagtactaaagagccaacattattttataagtgcctggcaataggtattcactagttgaatagtttaatttgaaatgaattaattttaaatgggagttgttcaaaactatgccactttttcttttgtcctttgtgttattaaaatttaattgataattgtgtatattatatatatggagtacaatgtgatgttttgatatatgtttacagtgtagaatgattaaatcaatgtaataaatttattgcctcataccattttttgtggtaaaaaaaccacttaaaatctactcttaatatttttgaaatgtacaatgcattatttattatactcaccattctgtgtaatagatcagtaaagtttattcctcttgtctaa

SEQ ID NO: 177094 - DNA, 1735 bp, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENST ID: ENST00000380840
  CDS Start-End: 1-666
atggcggcgacggcccgggaagatggcgccagcggtcaagagcgaggtcagcggggctgcgagcactatgacagaggatgtctcctaaaggcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaactgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtagagacaacagtgaacaataaagataaaagtccttgtcctcacagcagtacattctattgttcatcatatttgatcaatgtactcatttttctttatgcaaggagtggatgtcttattgtaaatgaatagaatatttcttccctaagcgtgtgaaaataggggatggatgagtgggaagggcatgggatattcctggcaagatctctgatttcataatacttttttgggctcatgtagtggaatt

SEQ ID NO: 177095 - DNA, 759 bp, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENST ID: ENST00000513257
  CDS Start-End: 1-759
atggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatga

SEQ ID NO: 177096 - DNA, 1123 bp, Homo sapiens
  Payload ID: 14750
  Gene Symbol: RCHY1
  Gene Name: ring finger and CHY zinc finger domain containing 1, E3 ubiquitin protein ligase
  ENST ID: ENST00000504085
  CDS Start-End: 118-441
atattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagagtgagtgtttgggattttaaaaataattaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatg

SEQ ID NO: 177097 - DNA, 1011 bp, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENST ID: ENST00000512706
  CDS Start-End: 167-886
ctgccccgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagc

SEQ ID NO: 177098 - DNA, 650 bp, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENST ID: ENST00000507014
  CDS Start-End: 12-650
aggtggaggagatggcggcgacggcccgggaagatggcgccagcggtcaagagcgaggtcagcggggctgcgagcactatgacagaggatgtctcctaaaggcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatga

SEQ ID NO: 177099 - DNA, 1304 bp, Homo sapiens
  Payload ID: 14750
  Gene Symbol: RCHY1
  Gene Name: ring finger and CHY zinc finger domain containing 1, E3 ubiquitin protein ligase
  Uniprot ID: Q96PM5
  ENST ID: ENST00000505105
  CDS Start-End: 27-593
gtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgtaggattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaatatgaccaggtattggagacagctggatgatgaagtagcacagactcctatgccatcagaatatcagaacatgactgtggatattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaac

SEQ ID NO: 177100 - DNA, 728 bp, Homo sapiens
  Payload ID: 14750
  Gene Symbol: RCHY1
  Gene Name: ring finger and CHY zinc finger domain containing 1, E3 ubiquitin protein ligase
  ENST ID: ENST00000513909
  CDS Start-End: 1-336
agcggtcaagagcgaggtcagcggggctgcgagcactatgacagaggatgtctcctaaaggtgacgccttctatggactcttccctgacaagcttccgtcaggcaccttgctgtgacaagctttatacttgccgcttgtgtcatgataacaatgaagatcatcaactagatcgctttaaagtgaaggaagtgcagtgcataaactgtgaaaaaattcaacatgcccaacagacttgtgaagaatgtagcacattgtttggagaatattattgcgatatatgccatttgtttgacaaagataagaagcagtatcactgtgaaaactgtggaatttgattggtccaaaggaagattttttccattgtttgaaatgtaacttatgcctagctatgaatcttcaaggaagacacaagtgtattgaaaatgtgtcccgacagaattgtccaatatgtttggaggacattcacacatcccgtgttgttgctcatgtcttgccatgtggacatcttttacatagaacgtgttatgaagaaatgttgaaagaaggctacagatgtccattatgtatgcactctgctttagatatgaccaggtattggagacagctggatgatgaagtagcacagactcctatgccatcagaatatcagaacatgactgtggatattctctgcaatgactgtaatggacgatccactgttcagtttcatatattaggcatgaaatgt

SEQ ID NO: 177101 - DNA, 7293 bp, Homo sapiens
  Payload ID: 14751
  Gene Symbol: RFFL
  Gene Name: ring finger and FYVE-like domain containing E3 ubiquitin protein ligase
  Uniprot ID: Q8WZ73
  ENST ID: ENST00000315249
  CDS Start-End: 224-1315
ggccgggccgggccggctggggatgggtgggagggggggccgacttcctggggccgcccgtgaggatgtcgcgaccgcccccgggtgcccctcagccccagagacgccgccgcggcggagtccgcagcctccctgcctgaggcgtccgcggccgggatccggcccctcccctcgcctcctctcctaggtgccggccgggagggcggccgcagcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcattttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagacacctgtcctgtctggtgcgaggatgttagaggttgataggactgacaaaagagcctgacagtggttcatgctataatttccacactttaggaggccaaggtgggaagactgcttgagctcaggagtttgagaccaacctgggcaatgtagtgagaccttgtctctacttaaaaaaacaaacaagggccgggtgcggtggctcacgcctgtaatcccagcactttgggaggctgaggcgggcagatcacgaggtcaggagatcgagaccaccctggctaacacggtgaaaccccgtctctactaaaaatacaaaaaattagccaggcgtggtggcgggtgcctgtagtcccagctactcgggaggctgaggcaggagaatggtgtgaacccgggaggcggagcttgcagtgagccaagattgcgccactgcagtccggcctgggcgaaagagcgagactctgtctcaaaaaacaaaacaaaaaaaaacacaaacaaaaaacccaaaaaaaccaaaaaattagccgtgcatggtggtgcatgtgggtagtcccaactacttggaaggctgaggtgggaggatcacttgagccaggagattgaagctgcagtgagctctgatcgccaccgcactccagccagggtgacagagtgagaccctgtattaaaaaaaaaaaaaaattgacaactgataaaccacaagctaatcctgggatgtgcacatggcctgggattagcctgtggttgggccaagtgaccttggtcaagatgctcagtgttgttgtaactaactaacttgctcaagaccacaaatgtaatatatggaagaggccatggaacaacctagaagagaatgagagctgggtaggtaaaggatgaatcccaagaccaattgggttgaagcaccaagtgagttcagatatttacactgatctagaagagatgggccttaaagaactgaaatctgaggacagttagtatgcccagttaggtcttcaggttaccctgggagatacatggtaccttttggatacagctgtagtacagctggactatggctcagaaaaggttggcccaggctgggcgccatggctcacgcctgtaatcccagcactttgggaggctgaggtgcgtggatgactcgaggccaggagtttgagaccagtctggacaacatggcgaaacgtggtctctactaaaaatacaaaaacttagctgcgagtgatggtgtgtgcctgtttgttaagtcttagccacttgggaggctgaggcatgagaattgcttgtgaacccgggaagcagaggttgcagtgagctgagattgcaccactgcactccagcctgaatgacagagcaagagtctgtttaaaaaaaaaaaaaaggttggcccagcctcgtgacagactgctgtgtgtgcgcaggcttgtacaaacctccctgaccaggcgcccaaggagcagggaaaagactactgagaatgcagcccctgggagaacaagattatgtgtccatctgctgtgactgagaagagaaaggaatcttgccaaaagggcataaaggatcgaggatgagccacaacactttgctcacattgccctagggagctgacctgttcagcacccagtgatgacctctgcttgatgccagccagcagcatgtagaggttcagaagagggaggcctccagcattctgctggagagatttatgatgatgatgttgagggctgcattgaaatacatgaaagaaatacatgaaaggatacaaaatagtatatacagtcagatctcagcagcaaagactggaagaaaatacataaaaaaccactgacattgaaatggcaataacacacactaaggcagagaagggacaagatgatcacctgcagccagcagaggccctttcctgtgagtgtgcactctgggtgtaagcaaccaataagggcaagtggggctgggtccaggttggagaggacagtgcctttggcaggatcctgaggagacagccttgttctgctgccctgtccggttgtttgtttggcctgaggctgaagagagaaatggaaatctatgtaggtcagtactcaaaggaggagcagctttttgtctccatagaggatggaataaaaagtatcttattcctaatactgaagcaaggctgaatggtgcctattcaaaaacaccaaatgtcctgggctagagtcaggaaagtaaacccctcccccgtgctgtccctactcccccaacatacacattttaaacagtaggtggaagccaaagtcaatcagatcaaagttgggggggggcggtggggtggccagggggcgcagtggtccttgatcttataggtccagagcctgttaatttgttcataaggtgagaactgaccctcaagagctggaaggattgggacatggcagccagtttacaaccatatggtgtcctgatgagcctgcactcagagtggagtgttggctggaacatgcacacctgcaactgagggttctaaagtcataggttaggcccttctcccgggtagggtctggacatgcacaccaggagtgacgttcccaactctagataactatgtgctaggctctgggctaagtgctttacataatgttgctcaggacaacaggacaaccctatgatttaggtgcacccattctacttggagggattgaggcttagatgttaacgtaacttgcctaaggttagagccattaagtttcaggagtctgatctgaactccgtctacacctgcactgtccagtgtggtagtcactagtgacatgtgaccatttgaagttgaattaaaataagaacttcagttccttagttgtgccagcttcatttcaattgctcagcagctgtctgtggctagtttggttggatactgcagatttatggatatttccactgctgcaaaaagttctattgaatagcacttgtctacactaaattgtctctcttccttttgttcttcaaataaatcagcctcaggtagcacaggagctgttctttgtaagcaggttgtatggatctgttctcaggtgtggatttttatttttttccctgcagatatggagtatattttctttaagaaattaaaaactaagaagaaaatgcca

SEQ ID NO: 177102 - DNA, 4227 bp, Homo sapiens
  Payload ID: 14751
  Gene Symbol: RFFL
  Gene Name: ring finger and FYVE-like domain containing E3 ubiquitin protein ligase
  Uniprot ID: Q8WZ73
  ENST ID: ENST00000394597
  CDS Start-End: 286-1377
aggttgcagttgactgcggttggttcaggctgagttgtttgggaagtacaaattttgcccagcgtgagtcagcactgccctgggtaaactccctgctgtgttgcaatcttgcttaccaaagatacatccccaggcggcaccattcacttcacatgaaagccgctgctcttggttcctgagatgatctcatctgaacatggctccagcgacctcagccacaggaactagagacagcttgctttctgtcgtggcaatgttttgaaactggcaaaatcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcattttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaataca

SEQ ID NO: 177103 - DNA, 2030 bp, Homo sapiens
  Payload ID: 14751
  Gene Symbol: RFFL
  Gene Name: ring finger and FYVE-like domain containing E3 ubiquitin protein ligase
  Uniprot ID: Q8WZ73
  ENST ID: ENST00000447669
  CDS Start-End: 585-1676
gggccgggccggctggggatgggtgggagggggggccgacttcctggggccgcccgtgaggatgtcgcgaccgcccccgggtgcccctcagccccagagacgccgccgcggcggagtccgcagcctccctgcctgaggcgtccgcggccgggatccggcccctcccctcgcctcctctcctaggtgccggccgggagggcggccgcagcagaactttgggggaagtgagaactgtgagcacaataatcttcagagaatgcacagtcctttgggtatttgtctactcatcagctgcttagtcagatggagtgttttcctaagtactactgaagtacacagttcagtctttattttgaaatctctccttctgccttctctccctcttccattactttgattaccttgatgggacattcaagctgtgcagtcgtatccttttatttctatagcctgcagaaaccaggttgaagattaactgtaggtgaacaggtaatcttatctacttggctagaaatcacccttcaagatgaaacacgtgttgacaaaggccccctagacttggggacatgaacaaagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatcc

SEQ ID NO: 177104 - DNA, 559 bp, Homo sapiens
  Payload ID: 14751
  Gene Symbol: RFFL
  Gene Name: ring finger and FYVE-like domain containing E3 ubiquitin protein ligase
  ENST ID: ENST00000414419
  CDS Start-End: 104-559
gtcctcgattatccccaagcgccctgcagaccggcaggtctagttggcttgtggggaaaagatacctctttgtacgtcagaagaaactgaggcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtcc

SEQ ID NO: 177105 - DNA, 1217 bp, Homo sapiens
  Payload ID: 14751
  Gene Symbol: RFFL
  Gene Name: ring finger and FYVE-like domain containing E3 ubiquitin protein ligase
  Uniprot ID: Q8WZ73
  ENST ID: ENST00000413582
  CDS Start-End: 91-1158
aaggagttcaagttgcttgccagactaacttacttttaaaagtaagcagccttccaagttaagagatgattttaaatttcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctca

SEQ ID NO: 177106 - DNA, 1706 bp, Homo sapiens
  Payload ID: 14751
  Gene Symbol: RFFL
  Gene Name: ring finger and FYVE-like domain containing E3 ubiquitin protein ligase
  Uniprot ID: Q8WZ73
  ENST ID: ENST00000415395
  CDS Start-End: 326-1417
gtcagggtgggtacctcaggcaggtttgctggaaaattccagtaaacagtttcaaaggagttcaagttgcttgccagactaacttacttttaaaagtaagcagccttccaagttaagagatgattttaaatttcagggaaagtggaagaggagaccctagcaggcttcaagcaagctctgtaggacagcagttagacactgtttttgaggactaaattgccaagtctgtcttttaagaagagggtgaggggagtttgggaaggaatgttcaagccctgagtgaagatccaataattttctttcaagatcagaaggagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaa

SEQ ID NO: 177107 - DNA, 398 bp, Homo sapiens
  Payload ID: 14751
  Gene Symbol: RFFL
  Gene Name: ring finger and FYVE-like domain containing E3 ubiquitin protein ligase
  ENST ID: ENST00000582308
  CDS Start-End: 16-398
gcaccagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaa

SEQ ID NO: 177108 - DNA, 424 bp, Homo sapiens
  Payload ID: 14751
  Gene Symbol: RFFL
  Gene Name: ring finger and FYVE-like domain containing E3 ubiquitin protein ligase
  ENST ID: ENST00000581039
  CDS Start-End: 1-424
ccacctctgttcccccagcccaggttcaggagaatcagcagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagta

SEQ ID NO: 177109 - DNA, 4039 bp, Homo sapiens
  Payload ID: 14751
  Gene Symbol: RFFL
  Gene Name: ring finger and FYVE-like domain containing E3 ubiquitin protein ligase
  Uniprot ID: Q8WZ73
  ENST ID: ENST00000584655
  CDS Start-End: 200-1183
gggtgggagggggggccgacttcctggggccgcccgtgaggatgtcgcgaccgcccccgggtgcccctcagccccagagacgccgccgcggcggagtccgcagcctccctgcctgaggcgtccgcggccgggatccggcccctcccctcgcctcctctcctaggtgccggccgggagggcggccgcagcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcattttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagacacc

SEQ ID NO: 177110 - DNA, 596 bp, Homo sapiens
  Payload ID: 14751
  Gene Symbol: RFFL
  Gene Name: ring finger and FYVE-like domain containing E3 ubiquitin protein ligase
  ENST ID: ENST00000581265
  CDS Start-End: 99-281
agcctccctgcctgaggcgtccgcggccgggatccggcccctcccctcgcctcctctcctaggtgccggccgggagggcggccgcagcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagtagtgctcaagatcacatagttattaaatgacagagccgggattcaaacccaggtccttgattccaaagcccctcccagaagacattcagcatgtcgagtagaagatgacagttacaggcctgggtgcctagaaaagcatggcaatgattaaaataagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctca

SEQ ID NO: 177111 - DNA, 3547 bp, Homo sapiens
  Payload ID: 14752
  Gene Symbol: RSPRY1
  Gene Name: ring finger and SPRY domain containing 1
  Uniprot ID: Q96DX4
  ENST ID: ENST00000394420
  CDS Start-End: 317-2047
actgagggagggctggggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggaggtagagaaaaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggttttttgtttgtttttttgttttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaaga

SEQ ID NO: 177112 - DNA, 3586 bp, Homo sapiens
  Payload ID: 14752
  Gene Symbol: RSPRY1
  Gene Name: ring finger and SPRY domain containing 1
  Uniprot ID: Q96DX4
  ENST ID: ENST00000537866
  CDS Start-End: 874-2604
gcgcgtaatggcagcgccgtggcctcgcgtccatctttgccgttctctcggacctgtcacaaaggagtcgcgccgccgccgccgccccctccctccggtgggcccgggaggtagagaaagtcagtgccacagcccgaccgcgctgctctgagccctgggcacgcggaacgggagggagtctgagggttggggacgtctgtgagggaggggaacagccgctcgagcctggggcgggcggaccggactggggccggggtaggctctggaaagggcccgggagagaggtggcgttggtcagaacctgagaaacagccgagaggttttccaccgaggcccgcgcttgagggatctgaagaggttcctagaagagggtgttccctctttcgggggtcctcaccagaagaggttcttgggggtcgcccttctgaggaggctgcggctaacagggcccaggtgagaggcagctatctatctcctggggtggctcctggtaccgatggggtcctgacctactcaggggtgcccgggatagaaagggtagatgaagggacgctttaggagggttctttttgtggagtttacggtctaggtggcacggatgaggcatacctccccggggagatttagaaacgccttgggatagagagagaatggggctaggaagcaggagctagaactagcggaatgtcctactacggaagccggagctgaaaattggaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaattagagttattccactggaagatccactgggaccagctgttataacattgttactagatgaatgtccattgcccactaaagatgcactccagaaattgactgaaattctcaatttaaatggagaagtagcttgccaggactcaagccatcctgccaaacacaggaacacatctgcagtcctaggctgcttggccgagaaactagcaggtcctgcaagtataggtttacttagcccaggaatactggaatacttgctacagtgtctgaagttacagtcccaccccacagtcatgctttttgcacttatcgcactggaaaagtttgcacagacaagtgaaaataaattgactatttctgaatccagtattagtgaccggcttgtcacattggagtcctgggctaatgatcctgattatctgaaacgtcaagttggtttctgtgcccagtggagcttagacaatctctttttaaaagaaggtagacagctgacctatgagaaagtgaacttgagtagcattagggccatgctgaatagcaatgatgtcagcgagtacctgaagatctcacctcatggcttagaggctcgctgtgatgcctcctcttttgaaagtgtgcgttgcaccttttgtgtggatgccggggtatggtactatgaagtaacagtggtcacttctggcgtcatgcagattggctgggccactcgagacagcaaattcctcaatcatgaaggctacggcattggggatgatgaatactcctgtgcgtatgatggctgccggcagctgatttggtacaatgccagaagtaagcctcacatacacccatgctggaaagaaggagatacagtaggatttctgttagacttgaatgaaaagcaaatgatcttctttttaaatggcaaccagctgcctcctgaaaagcaagtcttttcatctactgtatctggattttttgctgcagctagtttcatgtcatatcaacaatgtgagttcaattttggagcaaaaccattcaaatacccaccatctatgaaatttagcacttttaatgactacgccttcctaacagctgaagaaaaaatcattttgccaaggcacaggcgtcttgctctgttgaagcaagtcagtatccgagaaaactgctgttccctttgttgtgatgaggtagcagacacacaattgaagccatgtggacacagtgacctgtgcatggattgtgccttgcagctggagacctgcccattgtgtcgtaaagaaatagtatctagaatcagacagatttctcatatttcatgacacatgtgaagaggcatcgtggacttttttctactcaattccagccaatgttgaaaagaaaaagaaaaaaaaaactctctaatcagttgtacacacattgaaacttatagccatggccagattttatgctaaaaatggtagtttgtcaaagacaaaattctcttagaatctaatccaacttgccagccctgagaaaatcccttttaaggccaaggaaagctgaatgctagcagccaggcctgtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggttttttgtttgtttttttgttttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagtt

SEQ ID NO: 177113 - DNA, 579 bp, Homo sapiens
  Payload ID: 14752
  Gene Symbol: RSPRY1
  Gene Name: ring finger and SPRY domain containing 1
  ENST ID: ENST00000561641
  CDS Start-End: 63-579
ggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataaaagaaaacttcaaaatgaagatgcgtatataggcccttgcttccataagtcctcaaccgggattgtcgtctctcttcctggcatttctctgagtgatcaggaacctccctattcaatgataacattacacgaaatggcagaaacagatgaaggatggttggatgttg

SEQ ID NO: 177114 - DNA, 548 bp, Homo sapiens
  Payload ID: 14752
  Gene Symbol: RSPRY1
  Gene Name: ring finger and SPRY domain containing 1
  ENST ID: ENST00000562959
  CDS Start-End: 413-548
ctaggggactgagggagggctggggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggaggtagagaaagtggcacggatgaggcatacctccccggggagatttagaaacgccttgggatagagagagaatggggctaggaagcaggagctagaactagcggaatgtcctactacggaagccggagctgaaaattggaagaaaacttcaaaatgaagatgcgtatataggcccttgcttccataagtcctcaaccgggattgtcgtctctcttcctggcatttctctgagtgatcaggaacctccctattcaatgataacattacacgaaatggcagaaacagatgaaggatggttggatgttgtccagtctttaattagagttattccactggaagatccactgggaccagctgttataacattgttactagatgaatgtccattgc

SEQ ID NO: 177115 - DNA, 654 bp, Homo sapiens
  Payload ID: 14752
  Gene Symbol: RSPRY1
  Gene Name: ring finger and SPRY domain containing 1
  ENST ID: ENST00000568505
  CDS Start-End: 292-654
ggcggtacgaagcgggggtgggctctgcgcgtaatggcagcgccgtggcctcgcgtccatctttgccgttctctcggacctgtcacaaaggagtcgcgccgccgccgccgccccctccctccggtgggcccgggagaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacct

SEQ ID NO: 177116 - DNA, 743 bp, Homo sapiens
  Payload ID: 14752
  Gene Symbol: RSPRY1
  Gene Name: ring finger and SPRY domain containing 1
  ENST ID: ENST00000564435
  CDS Start-End: 305-743
ttcctaggggactgagggagggctggggcggtacgaagcgggggtgggctctgcgcgtaatggcagcgccgtggcctcgcgtccatctttgccgttctctcggacctgtcacaaaggagtcgcgccgccgccgccgccccctccctccgaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaatta

SEQ ID NO: 177117 - DNA, 692 bp, Homo sapiens
  Payload ID: 14752
  Gene Symbol: RSPRY1
  Gene Name: ring finger and SPRY domain containing 1
  ENST ID: ENST00000562439
  CDS Start-End: 255-692
agacttgattgggccattcacgcctcaggatgaggactggccagtctgcgcctggagggcgggccggtcccgctgatcacgtgacacgatttttgaaagaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataatgatcaggaacctccctattcaatgataacattacacgaaatggcagaaacagatgaaggatggttggatgttgtccagtctttaatt

SEQ ID NO: 177118 - DNA, 2124 bp, Homo sapiens
  Payload ID: 14753
  Gene Symbol: RFWD2
  Gene Name: ring finger and WD repeat domain 2, E3 ubiquitin protein ligase
  Uniprot ID: Q8NHY2
  ENST ID: ENST00000308769
  CDS Start-End: 1-2124
atgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcaaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagaggaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatga

SEQ ID NO: 177119 - DNA, 2022 bp, Homo sapiens
  Payload ID: 14753
  Gene Symbol: RFWD2
  Gene Name: ring finger and WD repeat domain 2, E3 ubiquitin protein ligase
  ENST ID: ENST00000367666
  CDS Start-End: 1-1701
gcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagaggaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccac

SEQ ID NO: 177120 - DNA, 2034 bp, Homo sapiens
  Payload ID: 14753
  Gene Symbol: RFWD2
  Gene Name: ring finger and WD repeat domain 2, E3 ubiquitin protein ligase
  ENST ID: ENST00000367667
  CDS Start-End: 1-340
cgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttgggaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 177121 - DNA, 3033 bp, Homo sapiens
  Payload ID: 14753
  Gene Symbol: RFWD2
  Gene Name: ring finger and WD repeat domain 2, E3 ubiquitin protein ligase
  Uniprot ID: Q8NHY2
  ENST ID: ENST00000367669
  CDS Start-End: 516-2711
cacctataccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 177122 - DNA, 975 bp, Homo sapiens
  Payload ID: 14753
  Gene Symbol: RFWD2
  Gene Name: ring finger and WD repeat domain 2, E3 ubiquitin protein ligase
  Uniprot ID: Q8NHY2
  ENST ID: ENST00000474194
  CDS Start-End: 106-579
cgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacag

SEQ ID NO: 177123 - DNA, 617 bp, Homo sapiens
  Payload ID: 14753
  Gene Symbol: RFWD2
  Gene Name: ring finger and WD repeat domain 2, E3 ubiquitin protein ligase
  ENST ID: ENST00000498306
  CDS Start-End: 50-617
ggagtagcgaggcagggtggggataataaagagccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagaggaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataata

SEQ ID NO: 177124 - DNA, 741 bp, Homo sapiens
  Payload ID: 14753
  Gene Symbol: RFWD2
  Gene Name: ring finger and WD repeat domain 2, E3 ubiquitin protein ligase
  ENST ID: ENST00000459744
  CDS Start-End: 1-741
tgagtggcttatactctcctgtcagtgaggatagcacagtgcctcaatttgaagctccttctccatcacacagccttgaattcagttctgatatgcacaggatctttgtcaatggaatacttattattagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaac

SEQ ID NO: 177125 - DNA, 773 bp, Homo sapiens
  Payload ID: 14753
  Gene Symbol: RFWD2
  Gene Name: ring finger and WD repeat domain 2, E3 ubiquitin protein ligase
  ENST ID: ENST00000491600
  CDS Start-End: 109-315
agagggaatcgagcgtttgcaggcattcgagctcctggttggtggggtgaaggaatgttggagtagcgaggcagggtggggataataaagagccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgtgcatactctgtctgctcctctctgcctcccttggttttgaatgctctctttccctctcctgatcctgaaaggctgattcagtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctcc

SEQ ID NO: 177126 - DNA, 4957 bp, Homo sapiens
  Payload ID: 14754
  Gene Symbol: RFWD3
  Gene Name: ring finger and WD repeat domain 3
  Uniprot ID: Q6PCD5
  ENST ID: ENST00000361070
  CDS Start-End: 99-2423
aagtggcagttggcgtaggtgcattcggagtgcggccgaggtaactaccgagtcttcggcgggctcgcgagcccggccgcggcctgctggtttcagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccagggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcagcggactgcagagacttcatggcatgctggaattcctgagaccttcatcttcaaaccacagtgtagggccaatgagaacaagaaggagggtatctgcttcacggagggcaagagccggagggtctcagaggacagacagtgccaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccagtgcaacaagaaagccaggcacagtgacattgtcgtcctttatgcccgaaccctgagagctttggacactagtgaacaggagcgcatgaaaagttccctactgaaggaacagatgctaaggaaacaggccgagttagaatcagcacagtgccgactccaactgcaggtcctcactgataagtgcactaggcttcaaaggcgtgttcaggacttgcaaaaacttacgtcacatcaaagtcagaatttacagcaacccaggggctcccaagcatgggtcctgagctgctcaccctccagccagggccagcacaagcacaagtaccacttccaaaagaccttcacagtatctcaggcaggaaactgccggatcatggcatactgtgatgctctgagctgcctggtgatatcacagccttctcctcaggcctcttttcttccaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagcttttacttgagtctcccctagtgtcagagatcaggagaaaagacataagagaatttacaaaagctattcagactgctattgaaaacatgagaagaacttgtctcccattttgagagttcctatctaaataaagccaattcctcagactgaggggctgttcttaagtgttctttatacattccagttatccagttaaagccttccccatgtgaagctgatgtttgattccagtttcctttgatttgcctccctaaccttttctagggctcagtttgtatttctttgccttgcctcagactactttgccaacccacttccacaacagaatatgcttcaagatgtgggcaggtcagtgtcctgttcatgggagaaaatggcttaacagtctgattttctcaaatgattattgaagagttgttatcgtttttattataaaacacttctgacctgtcaattcaagagctgtttctaggatctttctctccggcaaggggttgttgcactagatttccccagagttccaagttctagttgtgccttttaatgaccctttaatattttaggacataattttttccttttttaaatttttttgtagaaatagatgtttcactacgttgtccaggctggtcttggactcctggcctcaagcaatcctcccacctcagcctcctaaagtgccaaaattataggcgtgagccactgcacccggcccctatttgaagacgtcttttgtaaaagctagcttctagaacctgagaaaagctcttttctcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaaaaaacaaacaaacaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctatgtataatg

SEQ ID NO: 177127 - DNA, 586 bp, Homo sapiens
  Payload ID: 14754
  Gene Symbol: RFWD3
  Gene Name: ring finger and WD repeat domain 3
  ENST ID: ENST00000572337
  CDS Start-End: 513-586
attcggagtgcggccgaggtaactaccgagtcttcggcgggctcgcgagcccggccgcggcctgctggtttcagacggagtcttactctctctcccggtctggagtgcagtggcgtgatctcggctcaatgtaacctccactctccgggttcaaggggttctcctgcctcagcctcccaagtagctaggaccacaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctc

SEQ ID NO: 177128 - DNA, 528 bp, Homo sapiens
  Payload ID: 14754
  Gene Symbol: RFWD3
  Gene Name: ring finger and WD repeat domain 3
  ENST ID: ENST00000576652
  CDS Start-End: 161-528
aactaccgagtcttcggcgggctcgcgagcccggccgcggcctgctggtttcagagatgggaatttcactgtgttgcccaagctggtctggaacaccagagcacggagtcttactctctctcccggtctggagtgcagtggcgtgatctcggctcaattgatggctcatgaagcaatggaatatgatgttcaggtgcagttaaatcatgccgaacaacagccagctcctgctggcatggccagcagccaagggggaccagccctcctccagcctgttcctgctgatgtggtcagcagccagggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaactt

SEQ ID NO: 177129 - DNA, 599 bp, Homo sapiens
  Payload ID: 14754
  Gene Symbol: RFWD3
  Gene Name: ring finger and WD repeat domain 3
  ENST ID: ENST00000572990
  CDS Start-End: 148-599
agttggcgtaggtgcattcggagtgcggccgaggtaactaccgagtcttcggcgggctcgcgagcccggccgcggcctgctggtttcagacggagtcttactctctctcccggtctggagtgcagtggcgtgatctcggctcaattgatggctcatgaagcaatggaatatgatgttcaggtgcagttaaatcatgccgaacaacagccagctcctgctggcatggccagcagccaagggggaccagccctcctccagcctgttcctgctgatgtggtcagcagccagggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcagcggactgcagagacttcatggcatgctggaattcctgagaccttcatcttcaaaccacagtgtagggccaatgagaac

SEQ ID NO: 177130 - DNA, 3033 bp, Homo sapiens
  Payload ID: 14754
  Gene Symbol: RFWD3
  Gene Name: ring finger and WD repeat domain 3
  Uniprot ID: Q6PCD5
  ENST ID: ENST00000571750
  CDS Start-End: 210-2534
ggcgtaggtgcattcggagtgcggccgaggtaactaccgagtcttcggcgggctcgcgagcccggccgcggcctgctggtttcagacggagtcttactctctctcccggtctggagtgcagtggcgtgatctcggctcaatgtaacctccactctccgggttcaaggggttctcctgcctcagcctcccaagtagctaggaccacagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccagggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcagcggactgcagagacttcatggcatgctggaattcctgagaccttcatcttcaaaccacagtgtagggccaatgagaacaagaaggagggtatctgcttcacggagggcaagagccggagggtctcagaggacagacagtgccaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccagtgcaacaagaaagccaggcacagtgacattgtcgtcctttatgcccgaaccctgagagctttggacactagtgaacaggagcgcatgaaaagttccctactgaaggaacagatgctaaggaaacaggccgagttagaatcagcacagtgccgactccaactgcaggtcctcactgataagtgcactaggcttcaaaggcgtgttcaggacttgcaaaaacttacgtcacatcaaagtcagaatttacagcaacccaggggctcccaagcatgggtcctgagctgctcaccctccagccagggccagcacaagcacaagtaccacttccaaaagaccttcacagtatctcaggcaggaaactgccggatcatggcatactgtgatgctctgagctgcctggtgatatcacagccttctcctcaggcctcttttcttccaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgt

SEQ ID NO: 177131 - DNA, 706 bp, Homo sapiens
  Payload ID: 14754
  Gene Symbol: RFWD3
  Gene Name: ring finger and WD repeat domain 3
  ENST ID: ENST00000575113
  CDS Start-End: 358-706
gatcactgaaggagccgagttcgctgctgcggggcctgccctggccggggtgggaggtcgcccggcccttcccccgagagcctagcctcgggctcctcagcggcgttgcctgcgcccgctctgagcgccgattacttcatcactttaaagttgatggaagaacttcatttttaatttcatcacggaaactgtggagtaaagacttgtattatccctgttttacaggagaacaaacggagtcttactctctctcccggtctggagtgcagtggcgtgatctcggctcaatgtaacctccactctccgggttcaaggggttctcctgcctcagcctcccaagtagctaggaccacagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccagggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgt

SEQ ID NO: 177132 - DNA, 3282 bp, Homo sapiens
  Payload ID: 14755
  Gene Symbol: RNF6
  Gene Name: ring finger protein (C3H2C3 type) 6
  Uniprot ID: Q9Y252
  ENST ID: ENST00000346166
  CDS Start-End: 163-2220
gcttccttgtgagaatctaggtctctaagggaagcgttacttgaggctcggttgggaagagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgtatgtgaa

SEQ ID NO: 177133 - DNA, 3398 bp, Homo sapiens
  Payload ID: 14755
  Gene Symbol: RNF6
  Gene Name: ring finger protein (C3H2C3 type) 6
  Uniprot ID: Q9Y252
  ENST ID: ENST00000381570
  CDS Start-End: 292-2349
gggaaagaaaccagtagcgggacggagggcgggggtggcaagaaagtcaaggtttagaagtaagccggagacgcctaaccctggtaacatccgaatgggaacgggataggaaggaaggcctttgagagaggaggcgtaaacccaggaacagtgacagtgtaggacgaaaggcctaagtttgttgcggaagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaa

SEQ ID NO: 177134 - DNA, 3706 bp, Homo sapiens
  Payload ID: 14755
  Gene Symbol: RNF6
  Gene Name: ring finger protein (C3H2C3 type) 6
  Uniprot ID: Q9Y252
  ENST ID: ENST00000381588
  CDS Start-End: 593-2650
agagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgta

SEQ ID NO: 177135 - DNA, 1752 bp, Homo sapiens
  Payload ID: 14756
  Gene Symbol: RING1
  Gene Name: ring finger protein 1
  Uniprot ID: Q06587
  ENST ID: ENST00000374656
  CDS Start-End: 209-1429
gtgacgtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaacctgca

SEQ ID NO: 177136 - DNA, 1752 bp, Homo sapiens
  Payload ID: 14756
  Gene Symbol: RING1
  Gene Name: ring finger protein 1
  Uniprot ID: Q06587
  ENST ID: ENST00000383212
  CDS Start-End: 209-1429
gtgacgtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgatggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaacctgca

SEQ ID NO: 177137 - DNA, 1752 bp, Homo sapiens; identical to SEQ ID NO: 177135
  Payload ID: 14756
  Gene Symbol: RING1
  Gene Name: ring finger protein 1
  Uniprot ID: Q06587
  ENST ID: ENST00000430233
  CDS Start-End: 209-1429

SEQ ID NO: 177138 - DNA, 1752 bp, Homo sapiens; identical to SEQ ID NO: 177136
  Payload ID: 14756
  Gene Symbol: RING1
  Gene Name: ring finger protein 1
  Uniprot ID: Q06587
  ENST ID: ENST00000436128
  CDS Start-End: 209-1429

SEQ ID NO: 177139 - DNA, 1752 bp, Homo sapiens; identical to SEQ ID NO: 177135
  Payload ID: 14756
  Gene Symbol: RING1
  Gene Name: ring finger protein 1
  Uniprot ID: Q06587
  ENST ID: ENST00000427374
  CDS Start-End: 209-1429

SEQ ID NO: 177140 - DNA, 1750 bp, Homo sapiens
  Payload ID: 14756
  Gene Symbol: RING1
  Gene Name: ring finger protein 1
  Uniprot ID: Q06587
  ENST ID: ENST00000415941
  CDS Start-End: 207-1427
gacgtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaacctgca

SEQ ID NO: 177141 - DNA, 3825 bp, Homo sapiens
  Payload ID: 14757
  Gene Symbol: RNF10
  Gene Name: ring finger protein 10
  Uniprot ID: Q8N5U6
  ENST ID: ENST00000325954
  CDS Start-End: 462-2897
gagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagcattgtga

SEQ ID NO: 177142 - DNA, 2671 bp, Homo sapiens
  Payload ID: 14757
  Gene Symbol: RNF10
  Gene Name: ring finger protein 10
  Uniprot ID: Q8N5U6
  ENST ID: ENST00000413266
  CDS Start-End: 1-2451
atgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagagtttgctgcaacagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaaga

SEQ ID NO: 177143 - DNA, 412 bp, Homo sapiens
  Payload ID: 14757
  Gene Symbol: RNF10
  Gene Name: ring finger protein 10
  ENST ID: ENST00000537740
  CDS Start-End: 1-412
atgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagagtttgctgcaacagggtgtgctggagtatctgtctgccttcgatgaagaaaccacggaagtttgttctctggacactccttctagacctcttgctctccctctggtagaagaggaggaagcagt

SEQ ID NO: 177144 - DNA, 321 bp, Homo sapiens
  Payload ID: 14757
  Gene Symbol: RNF10
  Gene Name: ring finger protein 10
  ENST ID: ENST00000539486
  CDS Start-End: 297-321
attacacgcatgaaacactgcttatggcctgtttccgcctctgtctcctgggtaatggggaccacaggtgcgcaccgccacgccaggctaaagaaataaagtgatgtactgtatgaagaagtgccgtaaagtgatattaaattttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccg

SEQ ID NO: 177145 - DNA, 776 bp, Homo sapiens
  Payload ID: 14757
  Gene Symbol: RNF10
  Gene Name: ring finger protein 10
  ENST ID: ENST00000546262
  CDS Start-End: 478-776
tcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctc

SEQ ID NO: 177146 - DNA, 548 bp, Homo sapiens
  Payload ID: 14757
  Gene Symbol: RNF10
  Gene Name: ring finger protein 10
  ENST ID: ENST00000542207
  CDS Start-End: 1-548
ctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagggtgtgctggagtatctgtctgccttc

SEQ ID NO: 177147 - DNA, 635 bp, Homo sapiens
  Payload ID: 14757
  Gene Symbol: RNF10
  Gene Name: ring finger protein 10
  ENST ID: ENST00000540046
  CDS Start-End: 1-635
gtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctc

SEQ ID NO: 177148 - DNA, 661 bp, Homo sapiens
  Payload ID: 14757
  Gene Symbol: RNF10
  Gene Name: ring finger protein 10
  ENST ID: ENST00000538254
  CDS Start-End: 1-441
cgagagcgcaggattgagatagaggagaacaagaaacagggcaagtactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaaga

SEQ ID NO: 177149 - DNA, 1206 bp, Homo sapiens
  Payload ID: 14757
  Gene Symbol: RNF10
  Gene Name: ring finger protein 10
  ENST ID: ENST00000538796
  CDS Start-End: 225-479
cccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgaattactaatttcagctggattcaatttgttgtcagttgattctgtagtaaggccatatgttgcccctctggaggtgcttgtcaactactctggatgatggatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgat

SEQ ID NO: 177150 - DNA, 583 bp, Homo sapiens
  Payload ID: 14757
  Gene Symbol: RNF10
  Gene Name: ring finger protein 10
  ENST ID: ENST00000537997
  CDS Start-End: 212-583
gtcccagatccattcctctgtcgaagaggaagtcatccttcagtggctattcattgtggggttaagagcgcagactatgaattcagtctttttgggtcccagtttgccagaccttgaaattactaatttcagctggattcaatttgttgtcagttgattctgtagtaaggccatatgttgcccctctggaggtgcttgtcaactactctggatgatggatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataag

SEQ ID NO: 177151 - DNA, 644 bp, Homo sapiens
  Payload ID: 14757
  Gene Symbol: RNF10
  Gene Name: ring finger protein 10
  ENST ID: ENST00000536869
  CDS Start-End: 1-315
tccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgagctgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaag

SEQ ID NO: 177152 - DNA, 562 bp, Homo sapiens
  Payload ID: 14757
  Gene Symbol: RNF10
  Gene Name: ring finger protein 10
  ENST ID: ENST00000542438
  CDS Start-End: 207-562
gctgtttggcgactcgtcgccattcccggagcaggtcggcctcggcccagggtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgaattactaatttcagctggattcaatttgttgtcagttgattctgtagtaaggccatatgttgcccctctggaggagaaagtagcactagagcagcagctggcagaggagaagcacactcccgagtcctgctttattgaggcagctatccaggagctcaagactcgggaagaggctctgtcgggattggccggaagcag

SEQ ID NO: 177153 - DNA, 1336 bp, Homo sapiens
  Payload ID: 14757
  Gene Symbol: RNF10
  Gene Name: ring finger protein 10
  ENST ID: ENST00000545419
  CDS Start-End: 1-786
gaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccaggaattttactggcctgtggttggatctgaaagttaatgatgaaggagctattggaaaagcagactaaaagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagaga

SEQ ID NO: 177154 - DNA, 3477 bp, Homo sapiens
  Payload ID: 14758
  Gene Symbol: RNF103
  Gene Name: ring finger protein 103
  Uniprot ID: O00237
  ENST ID: ENST00000237455
  CDS Start-End: 970-3027
ggctccggccgcggccgccgctgatacacggttgtggagggtacggccgcggtctccggaggtggcgggggtgttggggacgggtgctgcgaccggcactgcccatccgagcgggacgggcgctgagtggccgggaggcagccgggtagccgcctggaggagcagtctcggggcctattattggttttttccctccgagaccgattccatctgcagagaccgcgacgccccatcctgggccgggccgcagtgcccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccgcgcagaacacgctgggccccgggcctggcccggccgagcgccgcgccctcctgacccgcggccgcgggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccgggggaagcgtccctcgttttgttcttccccgcgagctctccccgcgcccctctcctttctgtgcttaatggatgggggttttgagtttttcccctttatttttgtcggctcttgactgggaggcccggcgcgaggctctgcgtctctgcgtccctcgtcgccgcctcgcgcccgcgcggatcccgtcacctgcttccccgccggggatggccggccagtgacggcgccgggtggcccgcgcgtggacacggggccctcgcccaagctgccaccgagccgcggcccccgccctcgacccttctctctcccgtattccgagctctctggaaagagaggaaactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcatagcaaatgacagaagtcccttggtgggcaaaattcactgggagaaaatggttaaaaaggtgtcaagatttggaatacgtacaggcacatttaactgttccagtgatcccagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaagatta

SEQ ID NO: 177155 - DNA, 3084 bp, Homo sapiens
  Payload ID: 14759
  Gene Symbol: RNF11
  Gene Name: ring finger protein 11
  Uniprot ID: Q9Y3C5
  ENST ID: ENST00000242719
  CDS Start-End: 487-951
gcagtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacaactgaagttgtgcaatattttctgataattgctttttttattcttgtgttttctacttaaacataatgtctgtgtcatcaagtattatagtcagacttttctttttttctagattgttaaaattggcaaatgaacttttttaaaaatcatcttccatgttgcagttagtctttcttttcattacaagtctttcacagaagtttggtggtaatattgaaagaactagcattgggcagaatgtgtcttttttaggcactttatattctcaacatacaatgttaagaaccatcaattttgacttttactaagttgttaaataaagttataatacagctgtgaagggctaaa

SEQ ID NO: 177156 - DNA, 5913 bp, Homo sapiens
  Payload ID: 14760
  Gene Symbol: RNF111
  Gene Name: ring finger protein 111
  Uniprot ID: Q6ZNA4
  ENST ID: ENST00000348370
  CDS Start-End: 434-3394
agagccctagtgtcgtgctctcctcggtaggggaggaattggttaggcggcggcggcggcgaagcggcggcggcggctgtaggggagcagcggcagtggcggcgacggcgaggaggtgttcggtttgcgcagcgtagaaacgcccgcagcttcagagaaggagttcttgtgggaccaaattaggcattctgaacccacgccggcttagctgggccgagtccaggcgctgccgcacgtacagttttggtggcggtgacagacactgttcttgactctaggggcctattaggccgacgtctgaggcgcagatcgctggctctcgacgcattactctttacgccttacatttctgtcttccttcctgggtcagtgattcccggaccctggaagagaagagggtggctaatgattaaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttctattgtctttgtgtttcataattagtttttataaaaacagtttacattaaacatcttggaattcaacaatagtgatctcactcaaattgacatttgcataatttgacatttatattcattcagttatgactacttgcccttttcttcatattagtaaatgttacactgtagtagttgtcaatgttaacaggcttcaacatagtatgtgtgcagatggacgatggatttaaagagcataccttatgattaaaccgaggttatagaaggtcaggggagagtgaaggagtcagtgacctatgtctgccatcttactggggaaaagagcaagtagcctgtcttcctttaagtaagtagcctgtaatggatgtactactttgccactggaataccccgggtctgtgccaagggactgaagaagtgtaagatggggagaactgtatgtcatggagtcctcttgacgttcccccagatacaagtaaagcacaggtggatttctctatttttgaatactacatcagatttagatgcacgactacctgttgacttgttttataattgctactgatttttttaatgtaggcaaagctttgttactttgaaatttatttaataaaagtatttgtgacataaacctgaattgttaatataggagcttattaagctactgccattagttatcgaaaaatgtgataagtaatgaagaaagtaaggaagaaaatgactttgaacattttgactttttgtgctttgttttggtgtcttccatatcctgctgcatcttatatgtcaaaatgaacatttcagtggtagctgtccaaatacataaaaactaaaattcttttgttagcaagtccttatttttattgttgttaacatgcaagtgataaactgataatttgaaacatttttcttactctggtgactttcttttagctgctagcacacttcagcatttgaaccataacagttgtgataaactgatcgtttgaaacgtt

SEQ ID NO: 177157 - DNA, 4803 bp, Homo sapiens
  Payload ID: 14760
  Gene Symbol: RNF111
  Gene Name: ring finger protein 111
  Uniprot ID: Q6ZNA4
  ENST ID: ENST00000557998
  CDS Start-End: 288-3272
tggaggggagaaagaggaagggctgcggccgcggaaggctggggtcggtgaccggccggttatctctggctcggtggtgacttagggtctgggtctccgcagacgatttgtgtttgggcaaggcattcgtctaccgacacacccacagcctacagtgagggagtgtgggtgaggggatttctctcccacttccgactctccctagagtctcaggatgggggctgaggaccgaggcgtgggagtgcgatttgacaatggagtgatgaaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaaggtaacaactgattggttctcacagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttctattgtc

SEQ ID NO: 177158 - DNA, 900 bp, Homo sapiens
  Payload ID: 14760
  Gene Symbol: RNF111
  Gene Name: ring finger protein 111
  ENST ID: ENST00000559160
  CDS Start-End: 516-900
ctcggtaggggaggaattggttaggcggcggcggcggcgaagcggcggcggcggctgtaggggagcagcggcagtggcggcgacggcgaggaggtgttcggtttgcgcagcgtagaaacgcccgcagcttcagagaaggagttcttgtgggaccaaattaggcattctgaacccacgccggcttagctgggccgagtccaggcgctgccgcacgtacagttttggtggcggtgacagacactgttcttgactctaggggcctattaggccgacgtctgaggcgcagatcgctggctctcgacgcattactctttacgccttacatttctgtcttccttcctgggtcagtgattcccggaccctggaagagaagagggtggctaatgattaagatgcttgggatggaagaagtttgagtgacctatcctgtgtttatcctccttgccgtagctgagttgatctttttgaaaccctcttcccagactcttggatttatttattttattccagtgtgaatgcatgttttttccctcatagatggcagttctggattagcagttttaaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgc

SEQ ID NO: 177159 - DNA, 541 bp, Homo sapiens
  Payload ID: 14760
  Gene Symbol: RNF111
  Gene Name: ring finger protein 111
  ENST ID: ENST00000559757
  CDS Start-End: 148-541
agcagatgctggagctgctggtgctggagcagtttctgagcgcgctgccagccgacacgcaggcctgggtgtgcagccgtcagccgctaagctgggaggaggcggtggccctgctggaagagttctgggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgatt

SEQ ID NO: 177160 - DNA, 4536 bp, Homo sapiens
  Payload ID: 14760
  Gene Symbol: RNF111
  Gene Name: ring finger protein 111
  Uniprot ID: Q6ZNA4
  ENST ID: ENST00000561186
  CDS Start-End: 1-3012
atgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaactggtctttttgtgttctgtgtttccaggcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaaggtaacaactgattggttctcacagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttc

SEQ ID NO: 177161 - DNA, 699 bp, Homo sapiens
  Payload ID: 14760
  Gene Symbol: RNF111
  Gene Name: ring finger protein 111
  ENST ID: ENST00000559592
  CDS Start-End: 1-573
agctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggaggtatgtaaaaaagtgggggaggggagactttttgtcattactttcgttaggaaaagtattattgtttttaagtctaagattttagctatgttaataagcgggtattcttacattataataaacttcatatgtta

SEQ ID NO: 177162 - DNA, 5278 bp, Homo sapiens
  Payload ID: 14760
  Gene Symbol: RNF111
  Gene Name: ring finger protein 111
  Uniprot ID: Q6ZNA4
  ENST ID: ENST00000559209
  CDS Start-End: 137-3124
ctgaggcgcagatcgctggctctcgacgcattactctttacgccttacatttctgtcttccttcctgggtcagtgattcccggaccctggaagagaagagggtggctaatgattaaggctttccttaaagtttcccatgtctcaatggactcctgaatataacgagctctacaccttaaaagtggatatgaagagtgagattccttctgatgcaccaaagacacaggagagtctgaaagggatccttttgcatccagagcccattggggcagccaaaagttttcctgcaggagttgagatgattaatagtaaagtggggaatgaattctctcacctgtgtgatgattctcaaaagcaagagaaggaaatgaatggtaaccagcaagaacaagaaaaaagtctcgttgtgaggaaaaaacgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggactgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaactggtctttttgtgttctgtgtttccaggcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttctattgtctttgtgtttcataattagtttttataaaaacagtttacattaaacatcttggaattcaacaatagtgatctcactcaaattgacatttgcataatttgacatttatattcattcagttatgactacttgcccttttcttcatattagtaaatgttacactgtagtagttgtcaatgttaacaggcttcaacatagtatgtgtgcagatggacgatggatttaaagagcataccttatgattaaaccgaggttatagaaggtcaggggagagtgaaggagtcagtgacctatgtctgccatcttactggggaaaagagcaagtagcctgtcttcctttaagtaagtagcctgtaatggatgtactactttgccactggaataccccgggtctgtgccaagggactgaagaagtgtaagatggggagaactgtatgtcatggagtcctcttgacgttcccccagatacaagtaaagcacaggtggatttctctatttttgaatactacatcagatttagatgcacgactacctgttgacttgttttataattgctactgatttttttaatgtaggcaaagctttgttactttgaaatttatttaataaaagtatttgtgacataa

SEQ ID NO: 177163 - DNA, 3212 bp, Homo sapiens
  Payload ID: 14761
  Gene Symbol: RNF112
  Gene Name: ring finger protein 112
  Uniprot ID: Q9ULX5
  ENST ID: ENST00000461366
  CDS Start-End: 216-2111
gggtgagtccagcagcagcctcctctttcctgactgtcacatttcttttccagctctgaccgggagtcagctcctcggggataccatcccccgacctcaccttctacctaccgcagcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggagacgtgtcctgtgagggcggagccgctgctgctggttcgcatcaatgcctctgggggcctcatccttaggatgggggccatcaaccgctgcctgaagcaccctctggccagggacaccccagtctgcctcctcgctgtcctgggggagcagcactcagggaagtccttcctcctcaaccatttgcttcagggcttgccgggcctggagtctggtgagggcggccggccaagaggaggagaggcatccctgcagggctgcaggtggggcgccaatggcctcgccaggggcatatggatgtggagccaccccttcttgctggggaaagaagggaagaaggtggcggtgttcctggtggacacaggggatgccatgagccctgagctgagcagggaaacaaggatcaagctctgtgctctcaccacgatgctgagctcctaccagatcctcagcacctcccaggagctgaaggatacagacctggactatctggagatgtttgtccacgtggccgaggtgatgggcaagcattatgggatggtgccaatccagcatctggacctcttagttcgtgactcatcccaccccaacaaggcagggcaggggcatgtaggcaacatcttccagagattgtctggcagataccccaaggtgcaggagctgctgcaagggaagcgagcccgttgctgcctcttgcctgccccagggaggcggcggatgaaccaaggccatgcaagccctggtgacacagatgatgacttccgccaccttctgggggcctacgtctcagatgtgctgagtgcggccccccagcacgctaagagccgctgccaggggtactggaacgaggggcgcgccgtggccaggggggacagacgcctactcacggggcagcagctagctcaggaaatcaagaacctctcaggatggatggggaggacagggcccggtttcacctctccggatgagatggctgctcagctgcacgacctgaggaaggtggaagctgccaagagggagttcgaggagtatgtgaggcagcaggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcctggcagggggcgtggtgggtgctggcatggcagcagctgcactggctgcagaggctgggatggtggctgctggagctgccgtgggggccacaggggccgctgtggttgggggtggcgtgggtgctgggttggctgccacagtgggctgcatggagaaggaggaggatgagaggcttctggaaggggaccgagagccccttctccaggaagagtaacagccccaggaggtattgaaggacaggagagatgtcaggtggggatgaagaagaggggcaggtcgggggagggtgatgccagggattccaaggcaccgccatgtactgcactgccctggtcgaatgctcggtgtctgggtggcagctgagctgggactcaaggtggctcttggaacctgggaggcagcatctgggggcagtggatagaacacccggcctgtttctggttgcagatggttgccgatctgcccttgtcacagataggctacatcccagggtttctggctgcaagtgagactccaccctccccacctggctcatttccccgatgaccctggattgtaggaaagttaagcaggcaccatcctggaagtctacccctaggtggtcgagagacctgttctttcacagatgtgagaagccccaggatgattgaccatggtgttcaggagcggggagcactgatgaggtgctggggatgacaggaaggaaggaacactgggcagaaccagagagatgggacatggtagactgtggcccagaccccagagcagagaaacttgttcccatgacccttcccaaatctgctccagcaggactaaggtggctttcccactcctggcccacagccccagagagcctgtctgtgcatcctgaaccactctttgctgggcctccgcaagggcctctcttgggtctgtgtcctttttcaagcctgtttagatgggggagtgcccatgccctctgtgaagtgcccaaatgcgaaagaataacaccttttcttgcattctgagctaagccagacagcctttatactagattctatcaaaatcttgcaaaggaaaacaaaatgaacaacttctacccttaaacacatcctttctcccctgggcttgtaagaagatgcagcttgatgcagctcctcaaacaccaggccccctgggaactgggggtgcgggagttctccctctgggggacagaaaatctgactactaggaagacttctaggctatgaaactgacttctaggctatgaaacttacagggtatgggtgggcacattatcctttattttatgaaaaataaaatgtgtgtatgtgaa

SEQ ID NO: 177164 - DNA, 540 bp, Homo sapiens
  Payload ID: 14761
  Gene Symbol: RNF112
  Gene Name: ring finger protein 112
  ENST ID: ENST00000575165
  CDS Start-End: 171-540
gattctgagccgggctccatccctccctcctcggagccctgctacccgcagccgtgtctcctccccctgggcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgcccc

SEQ ID NO: 177165 - DNA, 1353 bp, Homo sapiens
  Payload ID: 14762
  Gene Symbol: RNF113A
  Gene Name: ring finger protein 113A
  Uniprot ID: O15541
  ENST ID: ENST00000371442
  CDS Start-End: 215-1246
cggccgcccgcgagcggggcggtgccacgtacggctccggaagaagcgacggaatctgctagggcacaagagagacgggcgctcgggctctcgcagtcctcttccgtcagtgtcttttgcttcgactcccggcggagcgcgcaacgtggagtgacgtgcaggggccaagtgcaacccaggcagccacggctgtttcggagctcaggactctaaaatggcagagcagctttctccaggaaaggcggtggatcaggtgtgcaccttccttttcaaaaagcctgggcggaaaggggctgctggacgcagaaagcgcccggcctgcgacccagagcccggagaaagcggcagcagtagcgacgaaggctgcactgtggttcgaccggaaaagaagcgggtgacccacaatccaatgatacagaagacccgtgacagtggtaaacagaaggcggcttacggcgacttgagcagcgaagaggaagaggaaaatgagcccgagagtctcggcgtggtttataaatccacccgttcggcgaaacccgtgggaccagaggatatgggagcgacagctgtctatgagctggacacagagaaagagcgcgatgcacaagccatctttgagcgcagccagaagatccaggaggagctgaggggcaaggaggatgacaagatctatcggggaatcaacaattatcagaaatacatgaagcccaaggatacgtctatgggcaatgcctcttccgggatggtgaggaagggccccatccgagcgcccgagcatctacgtgccaccgtgcgctgggattaccagcccgacatctgtaaggactacaaagagactggcttctgcggcttcggagacagctgcaaattcctccatgaccgttcagattacaagcatgggtggcagatcgaacgtgagcttgatgagggtcgctatggtgtctatgaggatgaaaactatgaagtgggaagcgatgatgaggaaataccattcaagtgtttcatctgtcgccagagcttccaaaacccagttgtcaccaagtgcaggcattatttctgcgagagctgtgcactgcagcatttccgcaccaccccgcgctgctatgtctgtgaccagcagaccaatggcgtcttcaatccagcgaaagaattgattgctaaactagagaagcatcgagctacaggagagggtggtgcttccgacttgccagaagaccccgatgaggatgcaattcccattacttaggtttcccataattcttaaatttaaaaaataaacgttttgttcttttggaagtcttacttcgtgtccttcctttgtagagaaagtgacagagcaggcgggtggtgaag

SEQ ID NO: 177166 - DNA, 1376 bp, Homo sapiens
  Payload ID: 14763
  Gene Symbol: RNF113B
  Gene Name: ring finger protein 113B
  Uniprot ID: Q8IZP6
  ENST ID: ENST00000267291
  CDS Start-End: 30-998
cacggccgttgggagcctgagactcaaacatggcagcgccaccttctccaggaaggacggccgaccaagcagaccaggtatgcaccttcctcttcaaaaagcctggacggaaaggggctgcaggcctcagaaagcgcccggcctgcgaccccgagcacggagagagcagcagcagcggggacgagggcgacacagtggctcagcccccgcgggtggcaccgaggccccggggcctccacagctggcagaaggcggctcacggcgacaggaggggcgaggaggcggcgcctgagagcctcgacgtggtgtacaggtccacccgctcggcgaagcctgtggggccagaggacatgggggccaccgctgacttcgagcaggacaccgagaaggagcaccatacgccgaccatcctcaagtgcagccagcgggtccaggaggcactgcggggtcgggagcacgaccacatctaccggggaatccacagctacctgaggtacctgaagcccaaggacacgtccatgggcaactcctcctcggggatggcgaggaagggccccatacgtgcgccagggcatctgcgcgccactgtgcgctgggattaccagcctgacatctgcaaggactacaaggagactggcttctgtggcttcggggacagctgcaaattcctccacgaccgttccgattacaagctcgggtgggagattgaacgggagcttgaagagggtcgctactgtatctgcgaggacgaaaaccatgaagtgggaagcgaggaagaggaaataccattcaggtgtttcatatgtcgccaggccttccaaaacccagtcgtcaccaagtgcaggcattatttctgcgagagctgcgcgctggagcacttccgggccaccccgcgctgctacatctgtgaccagccaaccggcggcatctttaaccccgccaaagaactgatggcgaaactgcaaaagcttcaggctgcagaaggaaaaaagagataagaaagactcaagtctgtatgtacactggggagaagcagcctgttgagtaagatgagagagatgacagtcttcctgcaatcccatgcctgagtatgtaaccaaaagaattgaaatccggatctcaaagaggtatgtgcactcccatgttcactgcagaattatttgcaaaagccaagaggtgtaaacaacccaagtgtccatggatggatgaatggacaaacaaaatgcgatacacacacacaatggaatgctattaagccttaacgggaaggaaatccttttaaagatttaaactgatccttttaaggatcacatgctacaactagaatgaaccttgaagacgacactgctaagtgaaataaactagtcacaaaatga

SEQ ID NO: 177167 - DNA, 2503 bp, Homo sapiens
  Payload ID: 14764
  Gene Symbol: RNF114
  Gene Name: ring finger protein 114
  Uniprot ID: Q9Y508
  ENST ID: ENST00000244061
  CDS Start-End: 66-752
gcgagccccgccccctcggcctcctcctcatcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaagtggtaa

SEQ ID NO: 177168 - DNA, 624 bp, Homo sapiens
  Payload ID: 14764
  Gene Symbol: RNF114
  Gene Name: ring finger protein 114
  ENST ID: ENST00000623528
  CDS Start-End: 78-290
gctcaccgccccgcgagccccgccccctcggcctcctcctcatcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgt

SEQ ID NO: 177169 - DNA, 2438 bp, Homo sapiens
  Payload ID: 14764
  Gene Symbol: RNF114
  Gene Name: ring finger protein 114
  ENST ID: ENST00000622999
  CDS Start-End: 37-186
atcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtgaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataactt

SEQ ID NO: 177170 - DNA, 580 bp, Homo sapiens
  Payload ID: 14764
  Gene Symbol: RNF114
  Gene Name: ring finger protein 114
  ENST ID: ENST00000625177
  CDS Start-End: 15-580
agagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggattatgatgttgatgaagaggacatgatgaatcaggtgttgcagcgctccat

SEQ ID NO: 177171 - DNA, 1284 bp, Homo sapiens
  Payload ID: 14764
  Gene Symbol: RNF114
  Gene Name: ring finger protein 114
  ENST ID: ENST00000622920
  CDS Start-End: 7-627
agcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtgatgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggcca

SEQ ID NO: 177172 - DNA, 569 bp, Homo sapiens
  Payload ID: 14764
  Gene Symbol: RNF114
  Gene Name: ring finger protein 114
  ENST ID: ENST00000623732
  CDS Start-End: 15-266
agagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcgctttgccttcacctgtaatgatagcagctcccgtttgtggtgcgttttgtaagggctggacactctgccaggggtctgctatacaaactgtatcctcccagcagtcctagagcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcct

SEQ ID NO: 177173 - DNA, 9117 bp, Homo sapiens
  Payload ID: 14765
  Gene Symbol: RNF115
  Gene Name: ring finger protein 115
  Uniprot ID: Q9Y4L5
  ENST ID: ENST00000582693
  CDS Start-End: 205-1119
tctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttttgttttttttttttgagatggagtctcgctctgtcgcctaggctgaagtgcagtggcacgatcttggctcattgcaaactctgcctcctgagttcaagcgattctcctacctcagcctccggagtagctgggaccacaggcatttgttaccatgcccagctaattttttgtatatttagtagagatggggtttcaccgtgttagccaggatggtctcaatctcctgaccttgtgctccgcctgcctcagcctcccaaagtgctgggattacaggcgtgagccactgcgcctggcctcttattttaatttttaaagactacttcagttgatgcagtttcccaagaaacctacataacatatattgggagccttatgttgataggaatctgattcccattcctttttgggaatgagttgggcagcatacaggcacagaaagacagatgtttgagacctttgcttctgagattttaaaaaatgattaccgctgggcgcggtggctcacgcctgtaatcccagcactttgggaggccgaggcaggcggatcacaaggtcaagagatcaagaccagcctggccaacaaggtaaaaccttgtctctactaaaaatataaaattagctgggcgtggtggtgcatgcctgtaatcccagctactcatgaggctgaggtgggagaatcgcttgaacccaggaggtggaggttgcggtgagccggatcataccaatgcactccagtctgggcaacaagagcgaaactccatctcaaaaaaaaaaaaaaaatccccaactcactgctttttttgtttgtttctgtcgcctaggctggagtgcagtggcacgatctcagctcaccacagcctcgacctcccaggctcaagtgatcctcccacctcagcctaccaagtggctgggactacaggcgtgtgccaccatgcctgggtaatttttgtatttttgtagagatagggttttgccgtgttgcccaggctggtctcaaactcctgggctcaagtgatctgcctgcctcaacctctcaaagtgctcaactcattgtttactgtcttttttcctagtaatcttaaaataatttgcctcacagaaatagagacagtaagtgtctgcagccagttcactgtttttggtaattcattggtcttcaggagttaagattttacattgtcacattttaatttttaagcctatttttcatctctgaaactttccttttctccttggttctggctatacttggactcaaactgatcagtgtgatcatgtccaaaacagcttggcctggaagaggtaggccttattttttcagcctagtagtgtcccatgcacatgctctttgtagcattcaagtgtttaacattggataaattaagaaggtcaagaatgttgttgaaacttcaaggtctcaaaaggaaatgatggggacatagaacaactgttggtgtaccaaaaaaaggtacagaggggcaccatttgtattgtcacacaacaatgatcagaatgatcagtttagaatgatcagaacaaaaacaccactctttaatgggtctttttcttggctagaagtctttcctcagtttttgttgactatcatacgctgatttgtgggtgacggaagggggctagagataacgtttctctgtactttggtaaaggatgaaggagtcagagagggaacagaaaaagtgagagagtggcctgctgaaataatagcctgcctctaaaagttgtgaccagaaagtatgattcatttgggcccagagggaataaaatatgttttttcatatacctcccatattacacctctgtagtgattgtttatttggggaatgagatctacttactgtgcgttgcccctgaaatgtagcttgagaatacacactggttttgaattggggaggaggatggaaggaaattagaggtgtattatgaatatttggccactacttagatggaggaaggctatgttgaacttgggacacattgcagttttcaagtacacaatatcagttgtctcagaaaaatcatgacagcctggacatatttgcttgtcagtgtctggagatgccaggacaggcagttgtagttttacgtacagatagagaaccaatgcctagagaactagaaaggatctgagtacctttaaaaagggtggaaacaaagtactggataggggtctgcctttttatacacagtatagcaaacagcatcagacaaagttacatgaagttttcttcactttttttgctctggtggatagaggatgtgagactcattttactgtttcccagacctgtcccacttaatggatctgttgtgtttcttcttataatggcaggcacctcagatgtccaggttaatttatgttgaggagttaggattcttcagggatttattattattattattattatttatttatttatttatttatttatttattttttgagatggaggcttgctctgtcgcctaggctggagtgcagtggtgcaatctcagctcactgcaacctccacctcctgggttccagcgattcttctgccttagcctcccaagcagctgggattacaggcacctgccaccatgcccagctaattttttatatgtttagtagagacaaggttttaccttgttggccaggctggtcttgaactctagacctcaggtgatctgccagtcgtggcctcccaaagtgctgggattacagacgggagccaccatgcccagcctgagatttattataaggaattggttcacacaataatggagtttgagaaatcccaagatctgcagtgggccagctagagatccaggagagctgatggtgtagttccagtctgaaggccagcttggataccctagaagagctgatgtttctgttccagttcagaggcaggaaaagactgaggtcttagttcaagcagtcaggcaggaggacttctcccttacttgttctattcagaccttcaactgattggatgagggccacttacattagggagggccatgtgctgtattcagtctactgactgaaatgttagtctcttccaaaaacaccttcacagacacacccagaatactgtatgaccaaatatctgggcatcatgtggcctagtcaagttgacacataagattaaccatcacaatgaggaaaaacagaaatgatacatgtatacagagtgctcctcatcccaattaagtttcaccaagttaataatgtgtctctatgagaagtggttcaccatgttggtcaggctgttttcaaactcctgacctcaagtgaccacccgcctcggcctcccaaagtgctgggattacaggtgtgagctagcactcccagccgacaggtgcttcttaaatgttttctttgagcaggaattggtccaggaattggttctcaagttagaaggaaaatttgaggggaagaacttgttttttctccaatcagtctctgattaaatagttattaggaaaaactccttgcttatgtctttgtattgcacatttttatatatgtatatatgtgtaaatagagatatttatatattcacagacaaacacgtgtatgcacatttcacaatggaggaagaagggatatggtgtgcactgaggtaaagtgagcagggatacagaagagagctggagcctcacagtctgattctctcattgtacataacctttagggtctttgtttccctgagttctctggtatggggcactgttggcttgggctggtaccctgttattctctgtgatgaagggattcactggaggtaaaaacgtaatcatttccaaaggttgagaataaatgactttgaggaaagggtgttcattatccgttgcttctatattataatcagttgaactacaatacggttatctattgattttttttaatttttctgacaaattattgacaccaaattgaataattcatgacctgcatgcttcagcttctttctccctggtttccaggtgctattccctcaagaaatgcaaattaaatatgtcggtcttaataaatcaggagggaagcatagtctgtgtctgttttaaatgacaacaacaacaaaacagctttggggtttaagaagtggaagacacatttttatttttttgagacacaatctcactctttcgcccaggctggagtgcagtggcgtgatctcaggtcactgcaacctcccgctcctgggttcaagcgattctcttgcctcagcctcccaagtagctgggattacaggcacgtgccaccatgcccagctaatttttgtatttttagtagagatggggttttgccatgttgcccaggctggtctcgaactcctgatgtcaagtgatcaccgacctcagcatcccaaagtgctgggattacaggcattagccaccacgcccaggtgagaagacagattttaagagaaggagcagggctggtatctgaataggtatttggatgttaggggaaaaccctttttggcctctgtggtagagcgatcggaaggtaaaagtgctgtttacaagaataatccattggagatctggggattggggacgacttataggatagagtcctcttgttgagaatttcccgaatgaatctcatgtaggttctgtcacagtaagatggaggaaaactttgatggggtaagtatcacaagtggctgtcctatagggggaaatcctagcctgcagtaatgtcagtgtctcagtattcagccagcgagccactgagctgctccaggggtttaaaatagaatgcatagaatacaatgtatacagctggtgatgctttccaggatcaaaatagagcccttgtctgatcccattgacattgtaaggtttcgatctctcatacctgccacagacaagtacattgtaggcattcaacttttaaggttttatacatgcaaactttatgttttcctgccacactacacttggtgtccacagaagtgtagtttgtatgttgcctcttcttcctctttcaaccagaacacttagatctgtgatcataggatgtaagcctgtgattctttactttttctaataagaaatacaattttcaagatccaaaaattattagattcttggctgggcattgtggctcatgcctgtaatctcagcattttggaaggctgaggcaggcagatcacttgaggtcaggagtttgagaccagcctgggcagcacaataaaacaccatgtctactaaaaatacaaaaattagccaggtgtggtggcatgcacctgtagtcccagctacttgggaggctgaggagggagaatcgtttgaaccaaggaggcagaggttgtagtgagccaagattgtgccactgcactccagggcaacagagagagaccctgtctcaaaacaaaaacccccaaattattagattcccttccaacaacttgatagccatattattagtatttttgattaaagaatacataacaaaaagctgctatgatttcagtaatgcttttaagttaatttattagtcacaccagaatctacatccaattgaaatatatacaaatatttgaaagatatttattcaggctgaagattatggtatatagattccttctgataacctcatggcctcacaggttcaaaacccgtgtttgtgaatcactcatacagattggggctaagatgcgtgtccagaaaaccacctattatgcatgaaaatttgtaggcttatttgaaggcaattgtatcaacacattttgaaagccaagacacaagtattttaagtttctgtttaaccaagtctcgagataagcagagtaaataaactctttagaagcaagactcagttggtatgtacaaagtgggattgctttgtatatattccgcttagtttgagtcagagctagtaatctgatgctcttaaatgtcttcataaacttgggcagtgatgtttcctttctgtgattatgtgtcacagatttttatatgtggactataattagtatagtacaatggctgaaacttttcctatagttggatatatcttctgagacttccagtgattgtataatgttgagtagctccagaagattatttgaatagtaaaaacaaaagacatctctacctatgtgagtttattatttagttagaaacacagaactaactatttaaaacaggtagagaaagattaagatgaatgtgatgtagtggagaaagctttggagactttggagtcagaactcaaatggctctaggtcccaaatccagactctcattttgattctcagaacaattctgtggaaagagaagatacaataggcaatatccctttttacagataggtaaacagaaatagcatctcaaaacctcatttgcactgggtgaggtggctcacgcctgtaatcccagcactttgggaggctgaggcgggtggatcacttgaggtcaggagtttgagaccagcctggccaacatggtgaaaccccgtctctaccaaaaacacaaaaattagccaggcatggtggtgcatgcctgtaatcccagctacttgggagactgaggcaggagaattgcttgaacccgggaggtggaggttgcagtgagctgagatcatgccactgcactccagcctgggcaacagagtgagactccgtctcaaaaaaaaaaaaaaaaaattcatttgcccaatgacaaatagctggtatgttgcagagccagaatttgaatccaggtctttttgcctccatggctagtccttttatctccatgggatacagtctaaaatccttagtttgaggttcaagactatcactaataagagtcttactcatctacttcagccatatctctttccgttcccacaaaccttagctcccacatttggcaggtccttgccaaggagcacaggtaaagtgtctctttccttttaatggctcaccatggagctgtagctaaatttctgtgctcttacccctttattcatgtagttcctcctatcaggaatatcctgcccactctctgcttaactatgacaagaggtcatctgtccaaagagaaagaagagagtttgtggatttaggagaaaagaaaagactccaaatactgctatgggcatttatttaaaaagagaaatgaccaaagaggttaacaagtatttagatgaagctgggcagttgtagtctgtggtgctcttggtctgcacaaatcttcctcttcctccagcagtgctgtatggatgttgttgaatgttgaggtctgtctgcattttctcattttcatgccaagtcaatcactggatctggctgtcttcctttctgtcctacctatctttgcttgttttctctctctttcctttgcagtgttaaataaaaatttattcccccaaaa

SEQ ID NO: 177174 - DNA, 2625 bp, Homo sapiens
  Payload ID: 14766
  Gene Symbol: RNF121
  Gene Name: ring finger protein 121
  Uniprot ID: Q9H920
  ENST ID: ENST00000361756
  CDS Start-End: 362-1345
acgtctcgctccttggagcccagactgagggagcgtcgcgaaagttgcccgttttggaacgctcccatttggctctccaaagggaagaattggttaaatagttgcactgaaaataatgcgattcaaatttctcattttccaagaacgctcccttgctgaagcttgcaagggcacggtactcccctctccttgaccctgaaacgtgcagcaagtagataacctcctgatccctgacagtctccgcctgtgttgatgccccgccccctctgctggagtccgagccgccgattggctaggagcacttgagcagcggaagcagctggctcgcgcggggactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtgcttgggccactcaggacccctctggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaagatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctg

SEQ ID NO: 177175 - DNA, 608 bp, Homo sapiens
  Payload ID: 14766
  Gene Symbol: RNF121
  Gene Name: ring finger protein 121
  ENST ID: ENST00000393711
  CDS Start-End: 36-377
gcgcggggactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaataggtggggtttcaccgtgttgcccaggctggtctcaagctcctgggctcaagcgatccatctgcctcagccccccaatgtgctcgaattacaggagtgagccaccatgcccggcctacagtagaaattttaaaccaaataaagaaaccagatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgcta

SEQ ID NO: 177176 - DNA, 2132 bp, Homo sapiens
  Payload ID: 14766
  Gene Symbol: RNF121
  Gene Name: ring finger protein 121
  ENST ID: ENST00000393713
  CDS Start-End: 87-704
gactgcggtgagggggcgagccgtgaagatggcggcagtggtggaggtggaggttggaggtggtgctgctggggaacgggagctggatgagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggcggtgctcagcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtgcttgggccactcaggacccctctggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaagatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctgaa

SEQ ID NO: 177177 - DNA, 2202 bp, Homo sapiens
  Payload ID: 14766
  Gene Symbol: RNF121
  Gene Name: ring finger protein 121
  ENST ID: ENST00000530137
  CDS Start-End: 39-926
ggaggttggaggtggtgctgctggggaacgggagctggatgagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtgcttgggccactcaggacccctctggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaagatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaa

SEQ ID NO: 177178 - DNA, 571 bp, Homo sapiens
  Payload ID: 14766
  Gene Symbol: RNF121
  Gene Name: ring finger protein 121
  ENST ID: ENST00000530058
  CDS Start-End: 45-290
agctggctcgcgcggggactgcggtgagggggcgagccgtgaagatggcggcagtggtggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaattgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagtt

SEQ ID NO: 177179 - DNA, 786 bp, Homo sapiens
  Payload ID: 14766
  Gene Symbol: RNF121
  Gene Name: ring finger protein 121
  ENST ID: ENST00000530655
  CDS Start-End: 94-252
gcgcggggactgcggtgagggggcgagccgtgaagatggcggcagtggtggaggtggaggttggaggtggtgctgctggggaacgggagctggatgagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatgttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattgg

SEQ ID NO: 177180 - DNA, 870 bp, Homo sapiens
  Payload ID: 14766
  Gene Symbol: RNF121
  Gene Name: ring finger protein 121
  ENST ID: ENST00000533380
  CDS Start-End: 89-592
gggactgcggtgagggggcgagccgtgaagatggcggcagtggtggaggtggaggttggaggtggtgctgctggggaacgggagctggatgagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtgcttgggccactcaggacccctctggctgtgtcggactggggagggatatgatggagagccagccagtggggctgtcagcagtggggggctttttaaaagaaaactattttgatgaatatatttaaaaaacctttttttattgtggagcataggaattgcccccctccaggctt

SEQ ID NO: 177181 - DNA, 2375 bp, Homo sapiens
  Payload ID: 14766
  Gene Symbol: RNF121
  Gene Name: ring finger protein 121
  ENST ID: ENST00000526549
  CDS Start-End: 70-219
gagccgtgaagatggcggcagtggtggaggtggaggttggaggtggtgctgctggggaacgggagctggatgagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaattagagacggggtttcactgtgttagccaggatggtctcgatctcctgaccttgtgatccgcctcggcctcccaaagtgctgggattacaggcgtgagccaccgcgcccggcagatttttacaacctattctgaagaaaatggtgaccctctttcagatgtgggttgttcccctctatttcacagtgaagctgcactggtggaggttcctagtgatctggatcttgttctctgctgtcacagcctttgttaccttccgagccacccgaaaacctctagtacagacaaccccaaggttggtttataagtggttcctgctaatctataaaatcagctatgccactggcattgttggctacatggctgtcatgtttaccctctttggtcttaacttattattcaagatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtgcttgggccactcaggacccctctggctgtgtcggactggggagggatatgatggagagccagccagtggggctgtcagcagtggggggctttttaaaagaaaactattttgatgaatatatttaaaaaacctttttttattgtggagcataggaattgcccccctccaggcttcaccctccctgcctaagcagggtgggggcagagccatgacatttttggtttaaaggagccttctcatctctggccgagaacactgctgggctcccaggtagctgaaggcctcagcccacccactcccttcttccctgtgtggggctcaagcctggtgcacttagtatagaagagctaacgtactcaggcttgtgccacgggtgagcactgaggccccaggtgtcctccctcccccactgtctgggacacaggacaggtgttgcgtctgactctgtctccccctgtccaagagctataggctggttgaggcaagtggaaccttatcagtgacttggccaacaagggaagccttggggcctcagaattcattgaagatttgttttgggacaactggaagaatcagcaccatggatactcgcccgtgggcagggctgtggtcagccaagaatagaggtcatatagttgggccatggggcaattgttggcagccatgactgacggccccttgtgcaagctcattcttcagtggatccttcagtggagtggtgacacgtgccagcggtcactctgccacatcacttccttcttgaaagcctaagagtgcgtatgcgtgtgtgtgtgtgtgtgtgtgtgtacgtgaggcagaagaatatgacagatgtcagcttctccctgtgtcagatgatatgtccttgaagctggcaggggattcccagtccagggaatatccctacatgatttttgtcattcatgggtcctccctgggcctgacaacgggagtggtgggtgggtgagaacaggttctgagagggggcttctaggaaggccccagccctagtcctaggcgacttgaataaagtgggaggtcaaacatgggccttcggcattgggtttctagggaatatggctcagtagggcctgccccttcaagggcagcaagaacgaagcaggatgttgtcactcccgtctgaataaagctccatgagctgggttggaaagctg

SEQ ID NO: 177182 - DNA, 812 bp, Homo sapiens
  Payload ID: 14766
  Gene Symbol: RNF121
  Gene Name: ring finger protein 121
  ENST ID: ENST00000525243
  CDS Start-End: 1-439
ggaggtggaggttggaggtggtgctgctggggaacgggagctggatgaggttgatatgtcagatctctctccagaagagcaatggagggtcgagcacgcacgcatgcatgccaagcaccgtggccatgaagctatgcatgctgaaatggtcctcatcctcatcgcaaccttggtggtggcccagctgctcctggtgcagtggaagcagaggcacccacgctcctacaatgatcaaaccagaagatgccatggactttggcatctcccttctcttctatggcctctactatggagttctggaacgggactttgcagaaatgtgtgcagactacatggcatctaccatagggttctacagcgagtcgggcatgcctaccaaacatctttcagacagtgtgtgtgctgtgtgtgggcagcagatctttgtggacgtcagtgaagaggggatcattgagaacacgtataggctgtcctgcaatcatgtcttccacgagttctgcatccgtggctggtgcatcgtgggaaagaagcaaacgtgtccctactgcaaagagaaggtagacctcaagaggatgttcagcaatccctgggagaggcctcacgtcatgtatgggcaactgctggactggcttcgatacttggtagcctggcagcctgtcatcattggtgtagtccaaggcatcaactacatcctgggcctggaatagtgatgaagagcatcagtggaaaacccaccccacacgccatggacctcagggcactctcctccctgcccacaaagacctcctgggtgggaaagactcaaaggggtg

SEQ ID NO: 177183 - DNA, 1868 bp, Homo sapiens
  Payload ID: 14767
  Gene Symbol: RNF122
  Gene Name: ring finger protein 122
  Uniprot ID: Q9H9V4
  ENST ID: ENST00000256257
  CDS Start-End: 403-870
agtttcggaaccccagccagctcacctctgcgccgctgaacccgatccgagcctccggcaaaggtttttccctcctcccccggccgagggcttctgcagcccgggcacccccgccccgcggcgccccacattcccccagcccggggcccttggcgcgtgcgctccgtgcggctgtgctccgcgggactttgtttgtttcctcctcgtccctctttgttgggctgaacaccagcctcgtcaaagccccccactccggagggagttcggcttctccagcagggcggctgcagcgcgctgccccgaccccgcctgcggcccctcacgccgctagtgctcccaccccgccctcctggcaccccgcctgcgtccgttcgcccgaggaagccaaccgcgacttcattgatgcacccattccagtggtgtaacgggtgtttctgtggcctgggactggttagcaccaacaagtcctgctcgatgccacccatcagtttccaggaccttccgctcaacatctatatggtcatcttcggcacaggcatctttgtcttcatgctcagccttatcttctgctgctattttatcagcaaactgcggaaccaggcacagagtgagcgatacggatataaggaggtggtgcttaaaggtgatgccaagaagttacaattatatgggcagacctgcgcagtctgtctggaagacttcaaggggaaggatgagttaggcgtgctcccgtgccaacacgcctttcaccgcaagtgtctggtgaaatggctggaagttcgctgtgtctgccccatgtgtaacaagcccattgctagtccctcagaggccacgcagaacattgggattctattggatgagctggtgtgagtgctgccgctacaccgagacctggagaagacctcttgcctcatggatgtctggtccctctgcacagctccaaccaacaggactgtagggtgatgacgatcactttcccagtgatgagaagggtggtctaggactgggcttctaccctcagtgcaagaccagtgccagatgtgcccccacttcctgcctcctgaagccttcttccctgctactccatgctggtggcctcacccatcaagaccactgtctcctggtactggactatctacctgccttgtccctgttctgggggaaggtgtccaccccgatcaagaacatggagaaagtcctctttcaaggctcccattaggaggatgagctgccttgacccagaagggatgagacgggctcttacctctctacaaccttccctccccttcccactccttccggagtaaggttagaagggaaggaaggaaagatcaaggaaccaagcgcctccacgggaggcgagggaggctctgtatgaaacagaagagcagggacataaaggaaaatgtcagtgtttacatgggacctatggaaacaaaggctggcgggcgccagctgactccagagtaagagagggcccttcccctgccaggacccacggtgctatccattcagtctcttcctcagttaatctcggagcttcctattccatgttgaggtttgtgggcccctctagaggagggctagttctatacttaaattgattcccaggggccttttttttttttttttttttttttttgatcaaaaggggtgtggggatgggggtgtctacggttaagcaacagatacctccttccctttgtaaatagtatttttatacttcatcctcgcctctcaggctttagatacgaaatctccagaatggaagggggtggggattttctgttcctccctggagtgggtgagggtgggagaaagttacatatttaaagaaaaataaatttaataacaagtttctctaacct

SEQ ID NO: 177184 - DNA, 4311 bp, Homo sapiens
  Payload ID: 14768
  Gene Symbol: RNF123
  Gene Name: ring finger protein 123
  Uniprot ID: Q5XPI4
  ENST ID: ENST00000327697
  CDS Start-End: 145-4089
gctggaggctcagcgcgcaagcgtgcgcgtgatttggccctgaacggacgccgtagccaagaggttgggcggatgttgtgagccgggtcgctgcggccgaggctccggcccccaggaccactggctgcccatgagagatgaaggatggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggaaacccctgaacttccagaacctgccagaacatttggaccagttgctacaggtggacaatgaggaggaggaaagccagggacaggttgaagggcggcttggcccatccactgtggtcctggaccacacaggcggctttgaggggcttctcctggtggatgatgacctgctgggggtgattggacacagcaactttggcaccatccgctctaccacatgcgtgtacaaagggaaatggctctacgaggtcctcatctcctcccaggggctcatgcagatcggctggtgcaccatcagctgccgcttcaaccaggaggagggggttggagatacacacaactcctatgcctatgatggcaaccgcgtgcgcaagtggaatgtgaccacaacgaattatggcaaggcgtgggcagcgggggacatcgtgagctgcctgattgacctggatgatggcactctgtccttctgcctgaacggtgtatcactgggcactgcctttgagaacctgtccaggggcctgggtatggcctacttcccagccatcagcctctctttcaaggagtccgtggccttcaactttggcagccgtcctctgcgctacccagtggcaggctaccggcccctgcaggacccaccgagtgctgacctggtgcgggcacagaggttgctgggctgcttccgggcagtgctgagtgtggagctggaccctgtggaggggcggctgttggacaaggagagctccaagtggcggttgcggggccagcccaccgtcctcctcacactggcccacatcttccatcactttgcaccgcttctgcgcaaggtgtatctggtggaggctgtgctcatgagcttcttgctgggcatcgtggagaagggcacacccacacaggcacagtccgtggtgcaccaggtcctggacctcttgtggctcttcatggaggactacgaggtacaagattgcctcaagcagttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccata

SEQ ID NO: 177185 - DNA, 481 bp, Homo sapiens
  Payload ID: 14768
  Gene Symbol: RNF123
  Gene Name: ring finger protein 123
  ENST ID: ENST00000443204
  CDS Start-End: 87-293
aagaggttgggcggatgttgtgagccgggtcgctgcggccgaggctccggcccccaggaccactggctgcccatgagagatgaaggatggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggcagcccccctgtgagctcaggggaaaggatgggatttagtgtcatctggctgatttcaaggacttgtggacccctggcagcctctcactctccccaggaaacccctgaacttccagaacctgccagaacatttggaccagttgctacaggtggacaatgaggaggaggaaagccagggacaggttgaagggcggcttggcccatccactgtggtcctggaccacaca

SEQ ID NO: 177186 - DNA, 2670 bp, Homo sapiens
  Payload ID: 14768
  Gene Symbol: RNF123
  Gene Name: ring finger protein 123
  ENST ID: ENST00000432042
  CDS Start-End: 261-2549
ctgaacggacgccgtagccaagaggttgggcggatgttgtgagccgggtcgctgcggccgaggctccgggacaggttgaagggcggcttggcccatccactgtggtcctggaccacacaggcggctttgaggggcttctcctggtggatgatgacctgctgggggtgattggacacagcaactttggcaccatccgctctaccacatgcgtgtacaaagggaaatggctctacgaggtcctcatctcctcccaggggctcatgcagatcggctggtgcaccatcagctgccgcttcaaccaggaggagggggttggagatacacacaactcctatgcctatgatggcaaccgcgtgcgcaagtggaatgtgaccacaacgaattatggcaaggcgtgggcagcgggggacatcgtgagctgcctgattgacctggatgatggcactctgtccttctgcctgaacggtgtatcactgggcactgcctttgagaacctgtccaggggcctgggtatggcctacttcccagccatcagcctctctttcaaggagtccgtggccttcaactttggcagccgtcctctgcgctacccagtggcaggctaccggcccctgcaggacccaccgagtgctgacctggtgcgggcacagaggttgctgggctgcttccgggcagtgctgagtgtggagctggaccctgtggaggggcggctgttggacaaggagagctccaagtggcggttgcggggccagcccaccgtcctcctcacactggcccacatcttccatcactttgcaccgcttctgcgcaaggtgtatctggtggaggctgtgctcatgagcttcttgctgggcatcgtggagaagggcacacccacacaggcacagtccgtggtgcaccaggtcctggacctcttgtggctcttcatggaggactacgaggtacaagattgcctcaagcagttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacattgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggtgatggaaccattcaggctgaggcagaagcagaaaaggggtctctagtgtgagccctaggagccctggtctgagacctctgtggcccagcaacacacttctgtggggggcggggaggggaggagcttcctctgtggttcaccctgcagcaaacaaacgtctgcaccctgccct

SEQ ID NO: 177187 - DNA, 4506 bp, Homo sapiens
  Payload ID: 14768
  Gene Symbol: RNF123
  Gene Name: ring finger protein 123
  ENST ID: ENST00000457726
  CDS Start-End: 100-2265
ggacgccgtagccaagaggttgggcggatgttgtgagccgggtcgctgcggccgaggctccggcccccaggaccactggctgcccatgagagatgaaggatggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggaaacccctgaacttccagaacctgccagaacatttggaccagttgctacaggtggacaatgaggaggaggaaagccagggacaggttgaagggcggcttggcccatccactgtggtcctggaccacacaggcggctttgaggggcttctcctggtggatgatgacctgctgggggtgattggacacagcaactttggcaccatccgctctaccacatgcgtgtacaaagggaaatggctctacgaggtcctcatctcctcccaggggctcatgcagatcggctggtgcaccatcagctgccgcttcaaccaggaggagggggttggagatacacacaactcctatgcctatgatggcaaccgcgtgcgcaagtggaatgtgaccacaacgaattatggcaaggcgtgggcagcgggggacatcgtgagctgcctgattgacctggatgatggcactctgtccttctgcctgaacggtgtatcactgggcactgcctttgagaacctgtccaggggcctgggtatggcctacttcccagccatcagcctctctttcaaggagtccgtggccttcaactttggcagccgtcctctgcgctacccagtggcaggctaccggcccctgcaggacccaccgagtgctgacctggtgcgggcacagaggttgctgggctgcttccgggcagtgctgagtgtggagctggaccctgtggaggggcggctgttggacaaggagagctccaagtggcggttgcggggccagcccaccgtcctcctcacactggcccacatcttccatcactttgcaccgcttctgcgcaaggtgtatctggtggaggctgtgctcatgagcttcttgctgggcatcgtggagaagggcacacccacacaggcacagtccgtggtgcaccaggtcctggacctcttgtggctcttcatggaggactacgaggtacaagattgcctcaagcagttgatgatgtctctgcttcggctgtaccgattctcacccattgtcccagacctgggcctacagatccattacctgcggctcactatcgccatcctgaggcatgagaagtcccgcaagtttctgcttagcaatgtcctcttcgacgtgctccgctccgtcgtcttcttttacatcaagagccccctgcgtgtggaggaggccggcctgcaggagctcattcccaccacctggtggccccactgctccagtagggagggcaaagagagcacggagatgaaggaggagaccgcagaggagcggctgcggcggcgagcctacgaacggggctgtcagcggctcaggaagcgcatcgaagtggtggaagaactacaggtccagatcctgaagctgctgctggacaataaagatgacaatgggggtgaagcttctaggtatatcttcctgaccaagtttcgcaagtttctgcaggagaacgccagtggccgggggaacatgcccatgctctgcccccctgagtacatggtctgcttcttacaccggctgatctctgccctgcgctactattgggatgaatacaaggcttccaatcctcatgcttccttcagtgaggaggcctacatcccgccccaggtcttctataatggcaaggtggactactttgacctgcagcgcctggggggcctcctctcgcacctgcggaagaccctcaaagatgaccttgcttccaaagccaacattgtgatcgacccactggagctccagtcaaccgccatggatgacctagatgaggatgaggagccagccccagctatggcccagcgccccatgcaggccctggctgttggggggccactgcccctgccccggcccggctggctcagttctccaactttgggccgagccaaccgcttcctcagcacagcggctgtgagcctcatgaccccacggcggcctctgagcacctcggagaaagtgaaggtccgcacgctgagcgtggagcagaggacccgtgaggacagtagttgaaggcagccactggaatgagggcttgctgctggggcggccccccgaggagcctgagcagcccctcaccgagaactcgctgctggaagtcctggatggggcggtcatgatgtacaacctcagcgtacaccagcagctgggcaagatggtgggtgtctccgatgatgtcaatgaatacgctatggctctgagggacacagaggacaagctccgccggtgccccaagaggaggaaggacatccttgcagagttgaccaagagccagaaggttttctcagaaaagctggaccacctgagccgccgtcttgcctgggtccatgccactgtctactcccaggagaagatgctggacatctactggctgctgcgcgtctgcctgcggaccattgagcacggtgatcgcacagggtctctctttgccttcatgcccgagttctacctgagcgtggccatcaacagctacagtgctctcaagaattactttggtcccgtgcacagcatggaggagctcccaggtgatggaaccattcaggctgaggcagaagcagaaaaggggtctctagtgtgagccctaggagccctggtctgagacctctgtggcccagcaacacacttctgtggggggcggggaggggaggagcttcctctgtggttcaccctgcagcaaacaaacgtctgcaccctgccctgggacctgcagccacagagccaacagctccctagcaaaggaaaacagacaagatggaacacggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccata

SEQ ID NO: 177188 - DNA, 531 bp, Homo sapiens
  Payload ID: 14768
  Gene Symbol: RNF123
  Gene Name: ring finger protein 123
  ENST ID: ENST00000454491
  CDS Start-End: 303-531
aagaggttgggcggatgttgtgagccgggtcgctgcggccgaggctccgggtgagtgaggggcggcagggctctgagcctggcgggttccggctattcccttcgcggtccgggctagtccagtgcgagggcacctgcagcgcagggatctgggtgcgaaactccgagcggaagctggtctggcaggtcctgtggagcttggggccaggcgggggcgacttgggggagccatgcgccgccctcgccgtccttgggctcccagacggacccccaggaccactggctgcccatgagagatgaaggatggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggaaacccctgaacttccagaacctgccagaacatttggaccagttgctacaggtggacaatg

SEQ ID NO: 177189 - DNA, 442 bp, Homo sapiens
  Payload ID: 14768
  Gene Symbol: RNF123
  Gene Name: ring finger protein 123
  ENST ID: ENST00000444689
  CDS Start-End: 1-78
ctgacccgcctggctgccattctcgccaaacactttgccgacgcacgcattgtgggcactggcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccac

SEQ ID NO: 177190 - DNA, 1555 bp, Homo sapiens
  Payload ID: 14768
  Gene Symbol: RNF123
  Gene Name: ring finger protein 123
  ENST ID: ENST00000433785
  CDS Start-End: 54-1334
tgggacctgcagccacagagccaacagctccctagcaaaggaaaacagacaagatggaacacggctatgaagagaccctgacccgcctggctgccattctcgccaaacactttgccgacgcacgcattgtgggcactgacatccgagactcactgatgcaggccctggccagctacgtgtgctacccacactccctgcgggctgtggagcgaatccccgaggagcagcgtatcgccatggtgaggaacctcctggcgccctatgagcagcggccctgggcccagaccaactggatcctggtgcggctctggaggggctgtggcttcgggtaccgctatacacggctgccacatctgctgaaaaccaaacttgaggacgccaatttgcccagcctccagaagccctgcccttccaccctgctgcagcagcacatggcggacctcctacagcagggtcctgatgtggcacccagcttcctcaacagcgtcctcaatcagctcaactgggccttctctgaattcattggcatgatccaagagatccagcaggctgctgagcgcctggagcggaactttgtggacagccggcagctcaaggtatgtgccacctgctttgacctctcggtcagcctgctgcgtgtcttggagatgactatcacactggtgcctgagatattccttgactggacccggcctacctctgagatgctgctgcggcgtcttgcacagctgctaaaccaggtgctgaaccgggtgacagctgagaggaacctgtttgatcgtgtggtcaccctacggctgcctggcctagagagcgtggaccactatcccattctggtggcagtgacgggcatcctggtgcagctcctggtgcgtggcccagcctcagagagagagcaagccacatcagtgctcctggcagatccctgcttccagctacgctcaatatgctatctcctgggacagccagagcccccagcacctggcactgctctgccagcccctgaccggaagcgcttctccctgcagagctatgcggattatatcagtgccgatgagctggcccaagtggaacagatgctggcgcacctgacctctgcatctgcccaggcagcagctgcctccctgcccaccagtgaggaggacctctgccccatctgctatgcccaccccatctctgctgtgttccagccctgtggccacaagtcctgcaaagcctgtatcaaccagcacctgatgaacaacaaggactgcttcttctgcaaaaccaccatcgtgtctgtagaggactgggagaagggagccaatacgagtactacctcctcagctgcctagccctcacagcctgtgccatcctggaacctccacctttgaacccagagccaggctgggccctatttatgagctccctttgcccttctcctgtatcccacaccaccacatccaacctccttgcctgcctgtatcctcattggtgggagcccagccatggccctaattgtgcctgagcttgactttcagtcagggccacagtgagcattaaattattattccat

SEQ ID NO: 177191 - DNA, 207 bp, Homo sapiens
  Payload ID: 14768
  Gene Symbol: RNF123
  Gene Name: ring finger protein 123
  ENST ID: ENST00000629802
  CDS Start-End: 1-207
atggcatccaagggggccggcatgtctttctcccgcaagagctataggctgacctcagatgctgagaaatccagggtcacaggcattgtgcaggagaagctgctgaatgactacctgaaccgcatcttttcctcttctgaacatgcacccccagcagccaccagcaggcagcccccctgtgagctcaggggaaaggatgggatttag

SEQ ID NO: 177192 - DNA, 6020 bp, Homo sapiens
  Payload ID: 14769
  Gene Symbol: RNF125
  Gene Name: ring finger protein 125, E3 ubiquitin protein ligase
  Uniprot ID: Q96EQ8
  ENST ID: ENST00000217740
  CDS Start-End: 493-1191
aggtcatttttgcagcttattgtgatgacaacagtggaggatggtcttccacttcaccttaaaagcggctgttctctgattatcattaagcatggccacgcccgcacttaacttctgacagtggggaaagcagctgtgtgtgatagcttggaaggtttactgctgcctcaagtcctcttctctgcagttgaggtttcaggtttcaatcctcccaataccacaagacagagcacggggcggctgccgcctccgcctccgcgccttaacctaggcggcttgccgaagatctcagccccgcggccgcgcgctcgccctgccctagaccagggttgggcgcagcggcggaggtggcttctgggctgcgcgagctgggagagctgggaggcggcgatcgcagctgggccgggacttccttcctccaccgcacggcaacaaaacaaccctgcggcaggcactgagtgcttcgcagctgtctgggcgagaggcacagcgatgggctccgtgctgagcaccgacagcggcaaatcggcgcccgcctctgccaccgcgcgggccctggagcgcaggagggacccggagttgcccgtcacgtccttcgactgcgccgtgtgccttgaggtgttacaccagcctgtccggacccgctgtggccacgtattctgccgttcctgtattgctaccagtctaaagaacaacaagtggacctgtccttattgccgggcatatcttccttcagaaggagttccagcaactgatgtagccaaaagaatgaaatcagagtataagaactgcgctgagtgtgacaccctggtttgcctcagtgaaatgagggcacatattcggacttgtcagaagtacatagataagtatggaccactacaagaacttgaggagacagcagcaaggtgtgtatgtcccttttgtcagagggaactgtatgaagacagcttgctggatcattgtattactcatcacagatcggaacggaggcctgtgttctgtccactttgccgtttaatacccgatgagaatccaagcagcttcagtggcagtttaataagacatctgcaagttagtcacactttgttttatgatgatttcatagattttaatataattgaggaagctcttatccgaagagtcttagaccggtcacttcttgaatatgtgaatcactcgaacaccacataattttattaaaacgaagggaaaagggaccactgaattgcaccatttaagatgctgcttgaacaaatgggagggaagttgtcaatgattgatgggcaaaaatgtacaacacagttatgtgtttgtccatgtttattgttatagtgcatttaaaaactgctttaattttaatggtttaaatctgttttacatccttgagattcttacacatctaacaacaaaaaaaattatctacatcagtcattgttacatggaaaagacaggtggtaggcaagtaggtggaggatctcggtttgcaaattagataatactctgtgtataatgctacatatcaataactaccatcatggttaggcacgataactaatctttgttctgtgtaaaaaaatatggagagtgaaacaaagtgcagacattcaaagaaataagaaatctgctccaatgctcttgttctaatctctaataggttaacgttaataatcttgtatgggagttggaaaggaaaattttggaagtcaagaaagtccatttaggccggacgcggtggcttacgcttgtaatcccagcactttgggaggctgaagcaggcggatcacaaggtcaggagttcgagaccagcctggccaacactggtctctgtgaaactccgtctctactaaaaatacaaaaattagctggacgtgttggcgggcatctgtaataccagctacttgggaggctgaggcagaagaatcacttgaacccgggaggcagaggttacagtgagctgagatcgcaccagtacactccagcctgggtaacagagctagactccatctcaaaaaaaaaaaaaaaaaaaatccatttaaccaaattgtcttacataatactgtaacaaaacaaattttgtgttagaaaagtatacttaattctttgactttttataactgcatacataagaattcaatatttttcaaatatttatagcttatttagaaatatttctataatataagcaatttcttaaaaaccatcagatgatacttacagtataagtattcacatccagactttttagtagaaaaccctaagggctttgatatcttttttgattgtaacattttaaaaattatgaaataaaagtactgaaaaccagacacaaaatttatagctgaatgccttattataaggaaatactcttttaggactcagccagtcaccccacgtgtcctttttgtgtcctgtcacaattacaaccccacaaaagtaactgctagactgatttaaatggtaatcactttgttgcatttgattactgctgccacacctaaatgcatatatctatattttaatattatcaatttaaagttgttattaaatgtatattttattttacatctcttttttaatctagaagttcctccttctttccagttccttaaaatttacctggtgaagaacctgatcctaggacctatagagtttcccatactttgtattttgctgattgcacactcatggcacggttcagcacattgccctgtcctctcgatattagcacacagtgcaggttcaggcacattgaatttgagaagacttaggttcagtcctttggcaagactgtaaatcacggtgtctttctttccttcctccttcttctctctctctctctctctctctttccttttctttctctttttttcagagttgcactctgttgcccaggctggagtacagtggcacgatctcgactcactgcaacctccatctcccgggttcaagcagttctcctgtttcagcctcccaagtagctgggactacaggtgcacgccaccatgcccggctaatttttgtatttttagtagaggggtttcaccataatggtcaggctggtcttgaactcctgaactcaagtgatccaccagccttggcctcccaaaatgctgggattacaggcatgagccaccatgcccagctaatttttgtatttttagtagagacagggtttcaccataatagccaggctggtctcaaactccttaccttgtgatccgcccacctcagccttccaaagtgctgggattataggcgtgagccactgtgcccggcctacagggtttttatctaacctttctgttacaactgtacctctccttctgtactgaaagtcctggttttcaagaacacagggcacgatagaattagaacatcccacaattactcatttcttttatttatcttacacttacagctgtctcagaataacaatagaaatacaaccacaaataatatggcaattgaaacaattaaaaagttttcatttgcttttctcattctttcccaatttttttttttttttgagatggagtctcgcgctcttgttgcccaggctggagtgcaatggcacgatctcggctcactgcaacctctgcctcctggattcaagcaattctcctgcctcagcttcccgagtagctgggattataggcatgcgccaccacgccctgctaattttgtatttttagtagagtcaggatttctccacattggtcaggctggcctcaaactctcgacctcaggtgatccgcctgcctcggcctcccaaagtgctgggattacaggtgtgagccactgcgcccgacatcccaatttttaaaatagttatactatgtcaacattttcagaacatactggtatagcatactgtactttcttccttttatcccccatttattcttagttcttcaactatatatttaacacttgcccccagttttgttttgttttgttttgaggaggaatcttgctctgttgcccaggctggagtgcagtggtgtgatcttggctcactgcaacctccgcctcccgggttcaagtgattctcctgcctcagcctctcgagtagctgggattacaagtgggcaccaccacacccggctaattgttgtatttttagtagagatgggttttgccatgttggccaggctggttttgaactcctgacctcaagtgatccacctgtgttggcctcctaaagtactgggattacaggtgtgtgccaccgcgccaggcaattgcccccagtttttatttgatggctctgactgtttctcatatctgactctttaattatgaatccagggcatagattagtatctccatcttgtaaggatgcaaagaagccatgaaaataagtaatatcaactcctgaggataaaacgttacttgactagagttagctttttaattgtaatcatttataaacttctttgttccttacatataagcatagtcataaccatggtacccaaaattttctataagttattgtaactccttaaaggtcttgctacagttcttttatccagtacaaataattgggaaaatgtaaagctgaatgaaatctagtgagcctcatatcctcccttttagatattgattttaagtttgcttttcacagctgctaaaaagtaacaactgatttttagttccacaacctctctttcttcaatttagatggatcatacaataaagcaaaatctggctggttacagtggctcacacctataatcccagcactttgggaggctgaggtggagggtctcatgagcccaggagttcaagaccaacctgggcaatatagtgagactctttctatttaaacaaaaacaaaaacaaacaaacaaacaaacaaaaagctgggcatgatgcacacctttagtttcagctactaaggaggctgaggttggaggatcacttgagcctaggaggtcaacactgcagtgagctatgatcatgctactgccctccagcctgggcaacagagcaagaccctgtctccaaaaacataaataattaaatataaataaaaataaagcaaaatctgttgggaaacgagaaaaaggagaggaatttttcaggaataatcataaaaagaaatgatcatcagactgaaagtccagagcctgagaaatgaaaacatatttttaagcattggtgttgaccatgcagacaaacttttgttaattcagagcgatacaaaaggcactttgaatctataaaacttgaaaaagttaaaaattgtatgtcggataaagctttaagtcatctgtcactattaacctcagtgcagcaattctgactcctgtgcctggattccttttatgataattttgccacctacaggacagattaggtgctggtcgcctgaattattttgtgttctgaattattttgagctctaaaatggtaaagtacaaatactcattgttttactgtgcctttggccttttataaaaaggtatttataattcgttgataaaaaccaatatttgaagctgttgattaccaacaaaaaagtttcactctctttatagtgcttcaggatacaactttttcagggccttattagagaaaaactgattcacatgttattcttctaaagctaaattattaaaatgtaggttgaaagattggattgattgtgaatctacactaaagatatggttccaggcagacctccttagagacctccaggcagacctccttactgtcttcagtgatgtttaatttcattactgttactgggtgccaagtgtctttcatttggaagtgaacttactccagttattgaatgtttatcatatcataatttgcatttttccaacattgaaggtattttaaaaagtcactaagagattcattcttttattattcaactacaaaaaaatagtgtaatgatcagaatttaaaatgtgtgattctttttcttctgtaagtatgtattgctatgataaataaaaaatggcaggaccattgtttttattaaaatatctactgtgtctattcttaaa

SEQ ID NO: 177193 - DNA, 416 bp, Homo sapiens
  Payload ID: 14769
  Gene Symbol: RNF125
  Gene Name: ring finger protein 125, E3 ubiquitin protein ligase
  ENST ID: ENST00000580209
  CDS Start-End: 1-121
tcttccttcagaaggagttccagcaactgatgtagccaaaagaatgaaatcagagtataagaactgcgctgagtgtgacaccctggtgtgtatgtcccttttgtcagagggaactgtatgaagacagcttgctggatcattgtattactcatcacagatcggaacggaggcctgtgttctgtccactttgccgtttaatacccgatgagaatccaagcagcttcagtggcagtttaataagacatctgcaagttagtcacactttgttttatgatgatttcatagtaagtatattttcttatttttacattatgttttcatgctgtcttgttaagcttacctttccgatccaagtgaataaaattatagaggaaaaaatgtgtatatagctatagtgttgagtattagcattaagt

SEQ ID NO: 177194 - DNA, 1694 bp, Homo sapiens
  Payload ID: 14770
  Gene Symbol: RNF126
  Gene Name: ring finger protein 126
  Uniprot ID: Q9BV68
  ENST ID: ENST00000292363
  CDS Start-End: 157-1092
cgcagctttcgccgctcccgcgcccccgctccgccccgcgtgccgtgcgtgccgtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 177195 - DNA, 963 bp, Homo sapiens
  Payload ID: 14770
  Gene Symbol: RNF126
  Gene Name: ring finger protein 126
  ENST ID: ENST00000589762
  CDS Start-End: 113-963
gtgcgtgccgtgcgtgagcgtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactc

SEQ ID NO: 177196 - DNA, 1671 bp, Homo sapiens
  Payload ID: 14770
  Gene Symbol: RNF126
  Gene Name: ring finger protein 126
  ENST ID: ENST00000605891
  CDS Start-End: 74-298
gcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcgcccccagcagactgcacgggcctgagcccccgaggtcacgcccccctcctctccccagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 177197 - DNA, 2817 bp, Homo sapiens
  Payload ID: 14771
  Gene Symbol: RNF128
  Gene Name: ring finger protein 128, E3 ubiquitin protein ligase
  Uniprot ID: Q8TEB7
  ENST ID: ENST00000255499
  CDS Start-End: 251-1537
gcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagctttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaa

SEQ ID NO: 177198 - DNA, 2654 bp, Homo sapiens
  Payload ID: 14771
  Gene Symbol: RNF128
  Gene Name: ring finger protein 128, E3 ubiquitin protein ligase
  Uniprot ID: Q8TEB7
  ENST ID: ENST00000324342
  CDS Start-End: 166-1374
atagagctgatgtatccagaggttatgttgctagaggtgagatcagttacctacgtgcaactgaaatttcaaacttctgttcagcagggacgtgagtggacaatggtgactgatagttggaaatatcagcaaacatcttaaattttatactcaaatgaatgagcaatgaaccaggagaataggtccagttttttttggctccttgtaatttttacctttttacttaaaattacagcatctttttcaatgagtgcctatgtgactgtgacttattacaatgaaaccagcaactacactgcaatagagacatgtgaatgtggcgtttatggattagcttcaccagtggctaatgctatgggagtggtaggcatccctaagaacaataactaccaagcttgtgaccacaacactgagtttagtaatactaagaagccctggattgcgctgatagaaagaggtaattgtacattttcagaaaaaattcaaacagcgggcagaagaaatgctgatgctgttgtgatttacaatgctccagagactggcaatcagacgatacagatggcaaattttggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagctttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaa

SEQ ID NO: 177199 - DNA, 839 bp, Homo sapiens
  Payload ID: 14771
  Gene Symbol: RNF128
  Gene Name: ring finger protein 128, E3 ubiquitin protein ligase
  ENST ID: ENST00000418562
  CDS Start-End: 92-839
tggaggaggggcaagcaaaggggaatgtagataactaaagtgaaatagagctgatgtatccagaggttatgttgctagagcatctttttcaatgagtgcctatgtgactgtgacttattacaatgaaaccagcaactacactgcaatagagacatgtgaatgtggcgtttatggattagcttcaccagtggctaatgctatgggagtggtaggcatccctaagaacaataactaccaagcttgtgaccacaacactgagtttagtaatactaagaagccctggattgcgctgatagaaagaggtaattgtacattttcagaaaaaattcaaacagcgggcagaagaaatgctgatgctgttgtgatttacaatgctccagagactggcaatcagacgatacagatggcaaattttggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacat

SEQ ID NO: 177200 - DNA, 2866 bp, Homo sapiens
  Payload ID: 14772
  Gene Symbol: RNF13
  Gene Name: ring finger protein 13
  Uniprot ID: O43567
  ENST ID: ENST00000344229
  CDS Start-End: 703-1848
cccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagagagaaagagagagtgggcagacatcgaagccaaacagcagtatcccggaagcactcatgcaactttggtggcggccactcagttttctctgccagtgtctggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttcca

SEQ ID NO: 177201 - DNA, 1939 bp, Homo sapiens
  Payload ID: 14772
  Gene Symbol: RNF13
  Gene Name: ring finger protein 13
  Uniprot ID: O43567
  ENST ID: ENST00000361785
  CDS Start-End: 129-917
agtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacagtaagtacagttgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccacttt

SEQ ID NO: 177202 - DNA, 2843 bp, Homo sapiens
  Payload ID: 14772
  Gene Symbol: RNF13
  Gene Name: ring finger protein 13
  Uniprot ID: O43567
  ENST ID: ENST00000392894
  CDS Start-End: 663-1808
ctctttagtaggtcgggtgagtgtagtgtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatccagtaaa

SEQ ID NO: 177203 - DNA, 583 bp, Homo sapiens
  Payload ID: 14772
  Gene Symbol: RNF13
  Gene Name: ring finger protein 13
  ENST ID: ENST00000490631
  CDS Start-End: 8-583
caacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacagtaagtacaggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgt

SEQ ID NO: 177204 - DNA, 586 bp, Homo sapiens
  Payload ID: 14772
  Gene Symbol: RNF13
  Gene Name: ring finger protein 13
  ENST ID: ENST00000466795
  CDS Start-End: 97-586
aagtacagatttctcaatgaagatgcacccattatttttccctttagtgtattttgattcgtgtcctgggagatcaggaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacat

SEQ ID NO: 177205 - DNA, 761 bp, Homo sapiens
  Payload ID: 14772
  Gene Symbol: RNF13
  Gene Name: ring finger protein 13
  ENST ID: ENST00000467977
  CDS Start-End: 312-761
gcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacagtaagtacagttgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagaccct

SEQ ID NO: 177206 - DNA, 777 bp, Homo sapiens
  Payload ID: 14772
  Gene Symbol: RNF13
  Gene Name: ring finger protein 13
  ENST ID: ENST00000482083
  CDS Start-End: 82-777
taattcatggcagaggtgggaattgaatgctcaaggttttaaatgcacagagagcaggatacaaggcagccatagttcacaatgttgattctgatgacctcattagcatgggatccaacgacagtaagtacagttgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagt

SEQ ID NO: 177207 - DNA, 1008 bp, Homo sapiens
  Payload ID: 14772
  Gene Symbol: RNF13
  Gene Name: ring finger protein 13
  ENST ID: ENST00000459632
  CDS Start-End: 512-1008
gctagggccagatactacggtcagtcagcagctctgcctgtatgcttgacttgacttgacttgcacttattaaataactttgtcccagagagaaagagagagtgggcagacatcgaagccaaacagcagtatcccggaagcactcatgcaactttggtggcggccactcagttttctctgccagtgtctggtaaattcctctattttgtcctaatctgacaatagtaaatagtaaatttccaaaactgtcgtttcatcatcagtttcagcaccgtgggcagctgctcgggtcctctcttgttgccccaaacctgcccggctattactgttcgtcagtgatgcagcagaaacagtgaaaactgatgcattcctttcaacaatgatgtgtttgttctccaaggagaacatctgcagtttttgatacaatataaataagtaaggtggctgtgcctccaaagagttcttctggagaaacagatcaattcaagatttaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaa

SEQ ID NO: 177208 - DNA, 593 bp, Homo sapiens
  Payload ID: 14772
  Gene Symbol: RNF13
  Gene Name: ring finger protein 13
  ENST ID: ENST00000466478
  CDS Start-End: 378-593
agaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagctgaatcacgtgggtaaataagaaagtggaaagtggaacactaaagaacttgatctgtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaa

SEQ ID NO: 177209 - DNA, 767 bp, Homo sapiens
  Payload ID: 14772
  Gene Symbol: RNF13
  Gene Name: ring finger protein 13
  ENST ID: ENST00000467996
  CDS Start-End: 343-396
ggatattcagtcatgaaatcagggtagggacttctcccgcagcgacgcggctggcaagactgtttgtgttgcgggggccggacttcaagtataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgc

SEQ ID NO: 177210 - DNA, 701 bp, Homo sapiens
  Payload ID: 14772
  Gene Symbol: RNF13
  Gene Name: ring finger protein 13
  ENST ID: ENST00000470151
  CDS Start-End: 461-701
cagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttggagagaaagagagagtgggcagacatcgaagccaaacagcagtatcccggaagcactcatgcaactttggtggcggccactcagttttctctgccagtgtctggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatag

SEQ ID NO: 177211 - DNA, 570 bp, Homo sapiens
  Payload ID: 14772
  Gene Symbol: RNF13
  Gene Name: ring finger protein 13
  ENST ID: ENST00000468648
  CDS Start-End: 224-570
tttgggacttaacccctgctagggccagatactacggtcagtcagcagctctgcctgtatgcttgacttgacttgacttgcacttattaaataactttgtcccagagagaaagagagagtgggcagacatcgaagccaaacagcagtatcccggaagcactcatgcaactttggtggcggccactcagttttctctgccagtgtctggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggata

SEQ ID NO: 177212 - DNA, 1027 bp, Homo sapiens
  Payload ID: 14772
  Gene Symbol: RNF13
  Gene Name: ring finger protein 13
  ENST ID: ENST00000474348
  CDS Start-End: 143-565
cgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacagtaagtacagttgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattc

SEQ ID NO: 177213 - DNA, 820 bp, Homo sapiens
  Payload ID: 14772
  Gene Symbol: RNF13
  Gene Name: ring finger protein 13
  ENST ID: ENST00000468289
  CDS Start-End: 1-550
agttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaagcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaa

SEQ ID NO: 177214 - DNA, 1104 bp, Homo sapiens
  Payload ID: 14772
  Gene Symbol: RNF13
  Gene Name: ring finger protein 13
  ENST ID: ENST00000491086
  CDS Start-End: 404-1104
acttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagtataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacagtaagtacagttgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtga

SEQ ID NO: 177215 - DNA, 1766 bp, Homo sapiens
  Payload ID: 14773
  Gene Symbol: RNF130
  Gene Name: ring finger protein 130
  Uniprot ID: Q86XS8
  ENST ID: ENST00000261947
  CDS Start-End: 400-1554
ggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaagtctgtgctgttgagtcttattaacca

SEQ ID NO: 177216 - DNA, 9945 bp, Homo sapiens
  Payload ID: 14773
  Gene Symbol: RNF130
  Gene Name: ring finger protein 130
  ENST ID: ENST00000522208
  CDS Start-End: 20-1279
ggcggctgccggagggacgatgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaagtggtcacttctttcatcgaaactccttgtcccctcggagtctggtgtatgaaagtgaattctccaccatcgaaccttctttggacatgtatgatgagaacaaaacctgaattttaaacatggcctggctgttggggtcactgcttttgtgatttgatttctgatcacctttcttattttgtattctcctgtcagcatccgttttggaagaatggcagcactttccaagcacaggttggggttcagggttaatttgcaaagttcccccaaggtgaggctttgaggacagtagcattgcccaggtgagccttgtggtattgaaaacccgcccaagctgatcattgaaggtgggcgcccagcaaggctggctgtttccagagaagaggccgggcccaggattaatgttgcattgcagacgcatctctgaacaatcacatgctgttctgcaccagggaagctggggtttttaacatccttttgtggtccctgcttacgatgcatactgccctgtgggagaagcttcctacccgcgtggagtacaggtgctgctccctgacctggctctggatgttcccctctcgcttattctacttcctgctgaagggccccttctaaagggggttgagagaaggccttgcctttgtatctcctctgagactctgaccacccacttcctgccagggcagggccgtgggagacccaggccgtggggccgggtctgtgtgcggggccaggcagccgtctgcgtcgctgttttccagcctccgtgttgagcatgacgtaaagtgacaagtgtttaagtcagcacgaaaacactgaaggcccctccgtccctgcagcctgtgaacacgtctactcggccacccgtcagtatagggagtgtgtgtatagggaggtggcacctgggagcccagcccagcagtgtctctgggcacagtgatttcagggggatggccagcagttgtgaaagacagaatgatctggaatgtctcattgggaagaccaaacccccttctcgctgcagataccagataagcacccatcttcactgtccactgtgcagcccagtcccctccagcagccccagcacagcatgaagaaggcacatgagcaccggccgacaggcttacaggacagggtgcagtggccagcatcccaggcatcagggacatgtgggatcttcccacacacctgggatgacatcgaattaacatgatgagaaaattgcatcttactgctaatcccagtacagaaccactatgggcaaatttataaaactaatctgcacaccctctttgcaaaaggacacacctgagttgagtctgcctctcattggcatgagctttgtgggggcgtgaggcgcacagacccttgctgtgagaacaggaaccccagtctccacatgcccagggtcagatccgacagcaaacgaagcagatgcgtgaatcccctgccctgttctcactgactgtggaatatacgtttgaagtgaacacttgccatttttccacgtgcagcttctcctaaagtgtcttttctcctaacgcgtcaataacgcctcagacacaggtgtgcctgaaggaaacctgcagagccccggatggggacaggcttcaggagcattgtcagagagcgggcagcggcatttcgttttcgctcatttgaggctagaatggtgcagattttaaaggtcttagcagcttttgtgttttaccttttaccaagggctttgggggtttttttgttttgtttttctttatgatagtcttcgtactataaaaatattttcaatgagcagcttcaatatagcatcgttcagaaaagcaggtttccccattgggctctcagagagagggtgagtctgcaggaagctggagcccatttgctggaggttccagacacgcgtctgcatttgtatgtgtttgacccacctgaaaggtaggagagctcagttcggatcattgccgtgttgtctataccacctccttgttttcccaaaccaaaacgcagatcctgatgtagcattttctcctgatttgaggtcttaccaatgtgtatacgttaaattccactcaagacagtttctttactgaaaaggtatgaaattacgtgagaagaagtacaaatttcaggcccctagaatctgtctattaatataacatttgaatttctgggaaatctggggcacacattcacggtagaataacaaggaggcattgcttgcaggggagcgtactcagaacagtgctgtggatcctggcttgacacccttttctggaaaattggggtcactctctggctcagctacagaatggcctgtctttgtcaggagggacactaacttctcattaaggccatgctcttcaggaacagagaggatgatttggtttttggtttcaggtttttatttttatttttgttttgagacagtctcactctgtcacccaggctgaagggcagtggcgcaaccttggctcactgcagcctccacctcctgggctcaagtgatcctcccacctcagcccaccgagtagctggcaccacaggcacgtgccaccacacccagctaatttttggattttctgtagagatatgggactttgccatgttgcccaggctggtcttgaattcctgggctcaagcaatccacccccacctcggcctcccaaagttccgggattccagttgtgagccaccatgcccagccaagaatggcattttttttttaatcccaaataacagcctctttactagctgctatgctgggggaaatccctgctaagtcgggaccctggcaggaagtggccggggctgcttgtccggtgagcattgtgaagacacacgtcgccacatgggcagcgcttccctgaggcgcttggggagcagtgttccgcctgctgcaggtgtgatggggtgcagagagtgagtgcctccgtggttgcaagtcttgccaccagcagcggttattaggaaatgtatgataacctcagtcattgttgaggggggaactgtttgaagtaaggaagaggctgaggagtcagctatttacaccacacatccacccccctgcctccagtggactgctgtgagctgggcctgtgcccgggtgaggagaccatgggcctgtgtggcaggatcagcaagtctagggccagggcagccatcagcatcctctgggagttggttgtgactattgaaatgcaaatgcttccgctttggtgattttttttttttttgagacggagtcttgctctgtcacccaggctggagtgcagtggcgcgatcttggctcactgcaacttccgcctcccgggttcacaccatcctcctgcctcagcctcccgagcagctgggactacaggcacctgccacgacgcccagctaattttttgtatttttagtagagatggggttttactgtgttagccaggctggtctcgatctcctgacctcgtgatccgcctgccttggcctcccaaagtgctgggattacaggcatgagccaccacgcctggccaagctttggtgacttttaacatcctaagggaggagtaacccctctttcctgttaatccagagggaggggagggaaggccagatagccagggcttccagcgcaggaggcagagcttggcagccactgatggtggtaagcatgtctgcccagggctgcctgcctctgccctcctcttgggaagacaagctctgcccccagctaaaaactcctcacaaccctgatgagccttgcttttgcagagaggccccagctcccctggtggtcctcaggcctggctgcgaggcacattcacgaggcactgccttgagcactgaggtctggcacctgccggcttccctgatgcggcaacagccccagctgccagtgagtctgatgatatttggaaaagtatttttaaaaacgagattactgaattttacaagcttgacattttctattggctttataagctcttctcatgtttttattaccctcacatccaatccgttcgagctacacgctaaatcaaattggtattttatatttttatttttttagaggcaggatctcgctctgtcacccaggcaggagtgcagtggcacagtcatggctcgctgcagccttgacctcgcctcagcctccccagtagctgggaccacaggctcatgccacgcacgcccggctgaagctagttttaactgaagaaaactcaaagtgttctctcgccgttaacctttattattgaggcattggctctgctataggaaaacgaggtgacgttaatgtcggtggttgacattaaccactggcaagtgacagtgtggctccttgacaagtggttgctgctcataaatgtcatgaaacaaaaacactgattttagagaagtgggattctacagttaatatcgccagcaaacttttattaagctctcactctgtgccaaacacatgcttgaagttggggtgaatctgtgaccattaagatgttggctgttcatgggcacgttatcaagcaactggggtgtgagagcgaatgataagagggtgaatctggatgaggagggacttccagggcacaggtggaggagaggcattgcagccatagagaggcccaagggaacagtcaagacaaggcggggacagtggccaggaggcgagggcagcacttcctgggcagggaaggcttgccagggagaccagactcctgtctctgtttggaaagaaaaggaaccgcactgggggtcagggaggctaggcacggcaccagcctgggatgccagtcccgcctgaggggccaaggcaaaggggaagcattcacagaccccacaccaggctctgacgccaagtggaagaagagggagatagaagcagaagcctgggcttccaggcctggttcctgggcgggtgttgatgggacccagggagagtcctgtggggatactttgggtctgggctggcaggggctctggaaggagaggcatggaggtgcgaacctggtgcccaggtggaggtgcagtgggggtaaggtggccaggctgcagacccctgcatcagaatgcctgcgaagctgtgggttttttgtttgtttgtttgttttatttcgagacagggtgtcactctgtcgcccagactggagtgcagtagcgccgtctcggctcactgcaagctccgcctcccaggatcaagtgattctcctgcctcagcctcccgagtagctggatttacagatgcatgccaccacgcccagctaattttttgtatttttagtagaaacgaggtttcaccacgttggccaggctggtctcaaactcctgacctcaaatgatccacctgcctcgtcctcccaagtgctggaattacaggtgtgagccgcaccagcctgttttttaattttatttagagacagggtctcactctgttgcccagactggagtgcagtggtgtaatcttggctcactgcagcctcaacttccagcgctaaagcaatcctcccacctctgcctcccgagtaactgggactacacacgcatgccactacacccaggtaatttttaaaaattttttttagagacagagcttctccatgttgcccaggctagcctcaaactcctgggctccagtgaccctcccgccttagtgtctcaaagtgctgggattacaggtatgagccaccacgcccggtcagaagctgtgtttttaagtggacataccatcttgtcctgctgaagtatctccatgtaatcacaatatctatgtcacccaaatctcctccttcctcctccctcccccaaaacacccccacaggcatgcataccctcccatgcgctggaggcagaatctcccaaggggagctggccaggagaggtgtccctgagttcagatggaggtggaagccagagtggggctgggaccacccagtgacatgaggatggggcttgggataaagccctggggacactgacatttaaagtgtggacagaaggagctactgaaggcaatggatttagaaaagcaattgagtatgatttccttcttcaagaaaggctgtccaactagctctcacttcctctcgtgtgttcagtgtcacccggaagcagagtttaatgtgactaaagtcaacattggctcacactgtcagggagtgtgggaagatgagtaaggactcatcgcagggcgatacccacagcttaaaataggcaccttcccctcccaggtctggttagggcagttgttacatatgaggggcgtggagttttgtcttgtattttggccttgttggtaaagcattccaaagcttcgacacaccctcctttcagcccattaggaaaggctgttgattgtaatattcacacagctccctgggctatggttaagagccttgcagaaggactgggagaagccctgtgtgtttgaagtattgtagcatcagaaaaaaacaccggaagaaggcaggtggggacaaggtgcctatgtctgctccttggaattcctttccttactgtccgaggcaactacagggaaagcaaagcgtgagcccccaaatccacacctgggaggaacgttcccctttgcaaggcatgggactggctggccctgtgtctcacgggggctctgagttttgaggtcacactagcctcctgaggcctggctgagagggctgggttgggggtcaggaggccccctgtagccacgaagctcctctggggcattgttaaaggttcaccctcttttttgtgggtatcctggaagatctcaagaaactgagcttggaagaagagaggctgagagggtctcccgccgcctgcgttctctgcagctatggccccacagcctccagtgaccatggaggggaaggtgccacccgccttggctgctgaaagggtgatgctcttatgcctgagtcttggctcctgtggtcctgcagagaccctgtgggggccgcccggtcgtcacctgcactcatcttgggttttccttccttttccaccctaagctgaaggtatttttttcctgttttcttcactctaacttggggaagaaggaagatcctttatggaaaagaaaaaaaaaaaagcacctttgaacgtcctgcaacttgagtttcaagctttcagaaggattcggtgctgctggcctgctcagacctccgcctgggctgtggagttcctcctgttggcccctcctctctgtaccacaaaagctctaggcggcccagccacccctgtgaaagcggcgcccgtagccagacgccaaggctgccgtcccgagccgagggtggcaccttgcccagcgcacgtgcattctcctgtgggaactcggagggcatgtggtgagcagtctcctgtcagttgaggtggaggctcccggcccatctttgctctcctcaggctgcccagctcctggcggcacatggtggcctggcaaagctgacttggcctcctcagttccccacccatccgcggatcatcgccttccctagccacctctctctatagccaccgacatctgcggagcgtcacagactggttctgagctgtggtttacaaattcaacccaacacagagtgaattcaaatttgcttttggaacagcctttatctccaattaagtgcaagtatatttacactatgtgatattaaaggacttctccaatgactgggaggtactgaaccaagatgtttgtaaagaaacggtggggtgaggtggttaggtagaatataccgtcctggccatttctcttccttcaggcgagtaagcgctccttcagcagaaaggctgcggattgctggctgtgctctgtggactgggccagtaggtgtggcccaggtccaggtcctggcacctctgctgagtgcccagcctgagatgacacatgccatcctggagagaagcagagagggtgctgtctccaggcgttctccagacagcctgggcctggcttgctgagccagctgcaggaggggatctcctgactggggcttgggaccagatctgctgcagagaggcaataactctgtctaaaaagaaaacttgtcccgtgtgattacaaaaacaggaaaaggctccaagctaggaaatgagatttgaggtatggagaacattctcacctgatggaagcatcctgttcctgtacaggaggaggagctggtgcaagccctaggccacatatgtcacagttgttttggaccctccgtagcttttatactcataaaatattaaagttgcccctttcatatttgggtcattgaaagagcccaccgtactctaggttcctgctcactatgcacaacatctcagaagatggcgtacaaaactatttttctaactatagcacaggtaatgtgggggtggggaggcttgggatatacctaaatgtggcaaatgatttatcttccaccttgagggatgaaaaggaaactatgcacttgaattttaattaaaattttaatttaattcattggatagcttgtgccagaaagaacagtcaatattcaagaagcaaaactgacgattagctcagtttcgggcctccctgtcgggggagttttcttgtctggaacacaaacacctacaagtagagtgtgagctggttcttgacaatcagatctcatcaaccctttgaaatgttctgggcagcacagctccttggtctgcatggttggtgtaagtataatcaagtagtgaaattgtatggtatatacctatatgccaacagtgtacacccgtatgtgcagaatttgctaatataaccatttcaataaaaacctattgaaaaagctga

SEQ ID NO: 177217 - DNA, 2263 bp, Homo sapiens
  Payload ID: 14773
  Gene Symbol: RNF130
  Gene Name: ring finger protein 130
  Uniprot ID: Q86XS8
  ENST ID: ENST00000521389
  CDS Start-End: 417-1676
cggcagccgcgcgagagggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaagtctgtgctgttgagtcttattaaccagacctgtgttttgagggctgatttgaagctcgcagacccagattgcatttgtttgtgtttcagagacagaatgtgctcctggctcccgtgagaggaacagggattgacacttactattggtgtcttcacattggctcctacccacatagggcgcaagagcggggacatcctgctggtgatgccgcttaggatggtcagttgatttactcattcttcaagggggacattcactctgtgataatttcttctctgtggttgatcagcctccaccagagctgcagcacccccagcagcagggacttgtaacatttgctccccactgtgcccctgcacccaacagagtgctttgcacatcgtaagtgctcaataaatatttgtggaatgaa

SEQ ID NO: 177218 - DNA, 1790 bp, Homo sapiens
  Payload ID: 14773
  Gene Symbol: RNF130
  Gene Name: ring finger protein 130
  ENST ID: ENST00000520911
  CDS Start-End: 412-837
gccgcgcgagagggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccagcgtcgtctcggagatgcagccaagaaagccatcagtaaattgacaaccaggacagtaaagaagggtgacaaggaaactgacccagactttgatcattgtgcagtctgcatagagagctataagcagaatgatgtcgtccgaattctcccctgcaagcatgttttccacaaatcctgcgtggatccctggcttagtgaacattgtacctgtcctatgtgcaaacttaatatattgaaggccctgggaattgtgccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaaaagaatggtttattattgccagttttggcctcctcagtgccctcacactctgctacatgatcatcagagccacagctagcttgaatgctaatgaggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaa

SEQ ID NO: 177219 - DNA, 1445 bp, Homo sapiens
  Payload ID: 14774
  Gene Symbol: RNF133
  Gene Name: ring finger protein 133
  Uniprot ID: Q8WVZ7
  ENST ID: ENST00000340112
  CDS Start-End: 239-1369
aagcagtatctagagttaacagtaggggatttatttttcaatctaaagtttttcacctctctctagtaagacatctgaaactcataagccatctttaagaatttcttacaaaaacatgctggaagacagtggatcttgtttgtatcctgaagatttttttctcttcgttattttaaattaattgtcaacagatgtgcaactgttaggttggttcttaagtcactcggagaagagagagatgcatctactcaaggttggcacttggagaaacaacactgcctcttcctggcttatgaagttcagtgttctttggcttgttagtcagaactgttgcagagcaagtgttgtttggatggcttatatgaacatatcatttcatgttgggaatcatgtgttgtcagagttgggagagactggagtctttggaagaagctccactttgaagagagtggcaggagttatagtgccaccagagggaaaaatccaaaatgcatgtaatcccaataccattttcagccgatcaaagtactcagagacctggcttgcacttattgaacggggaggttgtaccttcacacagaaaattaaagtggcaactgagaagggagccagtggagtgatcatctataacgttccaggtactggcaaccaggtgttccccatgtttcatcaggcatttgaagatgtcgttgtggttatgattggtaacttaaaaggcacggaaattttccatttaattaagaagggagttctcattacagccgtggttgaggtggggagaaagcacatcatctggatgaatcactatttggtctcttttgtgattgtcacaactgctaccttagcatatttcatcttttatcacattcatagactttgtttagcaaggattcagaaccggagatggcagcgattaacaacagatcttcagaacacatttggacaactccaacttcgagtagtaaaagagggggatgaagaaataaatccaaatggggatagctgcgtaatttgctttgaacgctataagcctaatgacatagttcgtattctgacttgtaaacattttttccacaagaattgcattgacccctggattttaccccatgggacatgccccatttgcaaatgtgatattcttaaagttttggggattcaagtggttgttgaaaatggaacagaacctttgcaagttctaatgtcaaatgaactgcctgaaaccttatcacctagtgaagaggagacaaataatgaagtttctcctgcaggaacctcagataaagtaatccatgtggaggagaaccctacttctcagaataatgacatccagcctcattcagtagtggaagatgttcatccttcaccttgatggcatgacttttgaggaagtgtattaaacctgtatgtgaaatcaggtcctaatactgacaagcagtttgtctgtt

SEQ ID NO: 177220 - DNA, 1905 bp, Homo sapiens
  Payload ID: 14775
  Gene Symbol: RNF135
  Gene Name: ring finger protein 135
  Uniprot ID: Q8IUD6
  ENST ID: ENST00000324689
  CDS Start-End: 52-684
gagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgcaa

SEQ ID NO: 177221 - DNA, 2892 bp, Homo sapiens
  Payload ID: 14775
  Gene Symbol: RNF135
  Gene Name: ring finger protein 135
  Uniprot ID: Q8IUD6
  ENST ID: ENST00000328381
  CDS Start-End: 874-2172
tttttaacctctttgggtcatctgggaggacgtggtgctcttttagctctaacattttctggttgcaatgcgtttaggactgggatgcgaagtgagtgagtgagtgagccttctcaggaaaacactttctagaattttgtccgagtgtctgttgggaaacgcgcttacatcccgcagaaggcggtaaggacacagcgcacaactctgcattatacctgcgagttaaaaagccaagggttcgctcactcaaccttgaatgcgcgtcagaatcacctgggggaggttttacaaaatacccgtgctccacccaagacaatgaaatcagactccctgcgagcggggccgaacatcagcatttttgaggacgctccctgtggctgtgcatcggtgatctttaatcccctgctacttgttagaggagctggatgacacttcgtgggctcattctcataaataagctgctgaatggagtcctctcctcccaagagttgtcggtgttgcatcttttttgttgtttatttttttttaagccaacggacgaagacatccaacggtgctgcatcttaatggagggacatccagctaaagggaatcttggagacctccgcgggtttctagcagctcgcggcatgttggtttcccagggcaagaggccgccactgaaggtcagctctgtctttccagctgggcactggaggctctaagtctgttttcagcaggatcggaggaaggagacggggtggcgccaaggaaggaggagaaaaggcggccgagaaaaggaggagggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgcaaca

SEQ ID NO: 177222 - DNA, 1261 bp, Homo sapiens
  Payload ID: 14775
  Gene Symbol: RNF135
  Gene Name: ring finger protein 135
  ENST ID: ENST00000443677
  CDS Start-End: 91-579
agggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcct

SEQ ID NO: 177223 - DNA, 2098 bp, Homo sapiens
  Payload ID: 14775
  Gene Symbol: RNF135
  Gene Name: ring finger protein 135
  Uniprot ID: Q8IUD6
  ENST ID: ENST00000535306
  CDS Start-End: 15-875
gccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggttctctgttgcccaggctggagtgcagtggcacaatcactgcagcctcgatctctcaggctcaggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgcaaca

SEQ ID NO: 177224 - DNA, 475 bp, Homo sapiens
  Payload ID: 14775
  Gene Symbol: RNF135
  Gene Name: ring finger protein 135
  ENST ID: ENST00000580444
  CDS Start-End: 1-475
tctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaact

SEQ ID NO: 177225 - DNA, 257 bp, Homo sapiens
  Payload ID: 14775
  Gene Symbol: RNF135
  Gene Name: ring finger protein 135
  ENST ID: ENST00000434242
  CDS Start-End: 1-257
ggaaagaggctcctgaagcacaaatgcagggttctctgttgcccaggctggagtgcagtggcacaatcactgcagcctcgatctctcaggctcaggagaactcctggaagccccgtcttcctcctcatgcccattgcctgaccagagccaccctgcactcaggagagcttctcggtttgctcagtgtccctccacggggggagctgattgcaaaggcaaagcaggttgagactctagacccaagagcactcagagtc

SEQ ID NO: 177226 - DNA, 2071 bp, Homo sapiens
  Payload ID: 14776
  Gene Symbol: RNF138
  Gene Name: ring finger protein 138, E3 ubiquitin protein ligase
  Uniprot ID: Q8WVD3
  ENST ID: ENST00000257190
  CDS Start-End: 88-543
gttcatgtagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgtcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttgg

SEQ ID NO: 177227 - DNA, 3570 bp, Homo sapiens
  Payload ID: 14776
  Gene Symbol: RNF138
  Gene Name: ring finger protein 138, E3 ubiquitin protein ligase
  Uniprot ID: Q8WVD3
  ENST ID: ENST00000261593
  CDS Start-End: 459-1196
gtcacaacccgcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagcaataggagtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgacatgtcctatttgtgtgtctcttccttggggagatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatagggatagactttacagatttatggaaattaaatttatggggaaaagtttatttttaatattacttatagctgagtcagaattaaaggagggaattgtattgatactccaatacctaaatttcacaataccacttaggaaagctatttcaacaaattacagttttattgttaaaacagagtcttatttgagatgtattgctttatttttcaattaaaagtggttttctccta

SEQ ID NO: 177228 - DNA, 613 bp, Homo sapiens
  Payload ID: 14776
  Gene Symbol: RNF138
  Gene Name: ring finger protein 138, E3 ubiquitin protein ligase
  ENST ID: ENST00000578914
  CDS Start-End: 374-613
atacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgccccggggcctcggctgcgaagatagcggcggccggacaggaagctcgaggaaagcgctgggccgggtctctacgaacacgtgaaggaaaagcagctccgtccacaacgccgcttcggggctcctagtttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagat

SEQ ID NO: 177229 - DNA, 493 bp, Homo sapiens
  Payload ID: 14776
  Gene Symbol: RNF138
  Gene Name: ring finger protein 138, E3 ubiquitin protein ligase
  ENST ID: ENST00000578107
  CDS Start-End: 168-493
gttcggccccgccctacccagggccccgcccccttcctggcgcgcgctgtatcctgatgcgatccccctcccccctccgggttcatgtagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatca

SEQ ID NO: 177230 - DNA, 503 bp, Homo sapiens
  Payload ID: 14776
  Gene Symbol: RNF138
  Gene Name: ring finger protein 138, E3 ubiquitin protein ligase
  ENST ID: ENST00000580499
  CDS Start-End: 76-503
agtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgttttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacagattaaattctatcgcatgagacatcattacaaatcttgtaagaagtatcaggatgaatatggtgtttcttctatcattccaaactttcagatctctcaagattcagtagggaacagttcttctggtcatcctacttttaagtgtcccctgtg

SEQ ID NO: 177231 - DNA, 420 bp, Homo sapiens
  Payload ID: 14776
  Gene Symbol: RNF138
  Gene Name: ring finger protein 138, E3 ubiquitin protein ligase
  ENST ID: ENST00000577999
  CDS Start-End: 1-201
agtgaaacatccacatctgataacacagaaacttaccaagagaatacaagttcttctggtcatcctacttttaagtgtcccctgtgtcaagaatcaaattttaccagacagcgtttactggatcactgtaacagtaatcacctatttcagatagttcctgtgatcctagccagattaccagaaatttcgttagtcatctaaatcagagacatcaatttgattatggagaatttgtgaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtca

SEQ ID NO: 177232 - DNA, 2637 bp, Homo sapiens
  Payload ID: 14777
  Gene Symbol: RNF139
  Gene Name: ring finger protein 139
  Uniprot ID: Q8WU17
  ENST ID: ENST00000303545
  CDS Start-End: 373-2367
gactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaata

SEQ ID NO: 177233 - DNA, 467 bp, Homo sapiens
  Payload ID: 14777
  Gene Symbol: RNF139
  Gene Name: ring finger protein 139
  ENST ID: ENST00000517684
  CDS Start-End: 264-467
agtggattgtgaaatgcgtctactgtaataatatgcaatgtcttgattacctgctgaaataaggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggca

SEQ ID NO: 177234 - DNA, 4213 bp, Homo sapiens
  Payload ID: 14778
  Gene Symbol: RNF14
  Gene Name: ring finger protein 14
  Uniprot ID: Q9UBS8
  ENST ID: ENST00000347642
  CDS Start-End: 289-1713
aaaaattcgaattctcgggccccatcagaactactgaaaagagcctcctgtgagcacagggctcgcagtaagtgggggtgacggtggtcgcgccggcagcgccgccttgggcctgcgggaggcgcccgagaggcaggggcgaccacggcggctgcgcagagtcctccctatgccggcggtcgcgccagcgggatccgcctggctcagctgacagctcccgagaacggaagaggcggcgcgccggttgagcagggcgtctctaggcctggtcggctggcggcggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaacagagttgctgctatttgttctgtcaccaaggcaactaatcacattttaaaactgttcggcatataacatattcttaaagtaagaaaaaaaaggtcacagaatagcatctcttttacctgggcttgtgactgagcttaggttttagggcccatattttgtttaaaccagatagtttcatggtcttccattcaggacattttgtgtaaaaattgaggttaatttgctgggcacagtggctcacgcctgtaatcccagcactttgggaggcctaggcgggcggatcacgaggtcaggagttcgagaccatcatggctaacacggtgaaaccccgtctctactaaaaatacaaaaaattagctgggcatggtggcaggcgcctgtagtcccagctactcaggaggctgaggcaggagaatggcatgaacctgggaggtggagcttgcagtgagccgagatagcgccactgcactccagcctgagcgacagagcgagactccttctcaaaaaaaaaaaaaaaaaaaattgaggttaaagaataaattaaagataagaaatggaaattaaaatgatttgttctacagtatatacctgagaagagtgatttctgtgatcaaagagttcaattcagatttattcagaaagagctactcagaagctctatagttcgtgagctacttgatattttctagagatcattttatgttaagctgttatacattgttgatgatgtcatagaagtaggaaagaagcctttataatacagttttatgaaagaaatgggagccttttttcccatttatgatattaaaaacaacacaggtatttggtgtttagtctcaaaaatttgtttggtcaccttagtgattcttaggtacaaagtcttcatcactcaattttaacaaagaaaatagggcttataaagttatacttttgaagcatgagttatgagctaattttaagatgtatagttttggtagagtacttttgtctcagtaaaatgaaagatttgggtaactccccaaatgccctgtaaaacaaatgggtttgtggaaggttgtggtgtcagcaaaatatatgatagaataaagagttttgtacct

SEQ ID NO: 177235 - DNA, 3999 bp, Homo sapiens
  Payload ID: 14778
  Gene Symbol: RNF14
  Gene Name: ring finger protein 14
  Uniprot ID: Q9UBS8
  ENST ID: ENST00000356143
  CDS Start-End: 75-1499
gtgcatgggcttcctcacttttttcctcacgaagaggtctctggtctcccctctctgagcactctgaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaacagagttgctgctatttgttctgtcaccaaggcaactaatcacattttaaaactgttcggcatataacatattcttaaagtaagaaaaaaaaggtcacagaatagcatctcttttacctgggcttgtgactgagcttaggttttagggcccatattttgtttaaaccagatagtttcatggtcttccattcaggacattttgtgtaaaaattgaggttaatttgctgggcacagtggctcacgcctgtaatcccagcactttgggaggcctaggcgggcggatcacgaggtcaggagttcgagaccatcatggctaacacggtgaaaccccgtctctactaaaaatacaaaaaattagctgggcatggtggcaggcgcctgtagtcccagctactcaggaggctgaggcaggagaatggcatgaacctgggaggtggagcttgcagtgagccgagatagcgccactgcactccagcctgagcgacagagcgagactccttctcaaaaaaaaaaaaaaaaaaaattgaggttaaagaataaattaaagataagaaatggaaattaaaatgatttgttctacagtatatacctgagaagagtgatttctgtgatcaaagagttcaattcagatttattcagaaagagctactcagaagctctatagttcgtgagctacttgatattttctagagatcattttatgttaagctgttatacattgttgatgatgtcatagaagtaggaaagaagcctttataatacagttttatgaaagaaatgggagccttttttcccatttatgatattaaaaacaacacaggtatttggtgtttagtctcaaaaatttgtttggtcaccttagtgattcttaggtacaaagtcttcatcactcaattttaacaaagaaaatagggcttataaagttatacttttgaagcatgagttatgagctaattttaagatgtatagttttggtagagtacttttgtctcagtaaaatgaaagatttgggtaactccccaaatgccctgtaaaacaaatgggtttgtggaaggttgtggtgtcagcaaaatatatgatagaataaagagttttgtacct

SEQ ID NO: 177236 - DNA, 2905 bp, Homo sapiens
  Payload ID: 14778
  Gene Symbol: RNF14
  Gene Name: ring finger protein 14
  Uniprot ID: Q9UBS8
  ENST ID: ENST00000394514
  CDS Start-End: 464-1510
ggaagaggcggcgcgccggttgagcagggcgtctctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcgctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataatt

SEQ ID NO: 177237 - DNA, 4173 bp, Homo sapiens
  Payload ID: 14778
  Gene Symbol: RNF14
  Gene Name: ring finger protein 14
  Uniprot ID: Q9UBS8
  ENST ID: ENST00000394519
  CDS Start-End: 249-1673
gtgcatgggcttcctcacttttttcctcacgaagaggtctctggtctcccctctctgagcactctgagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaacagagttgctgctatttgttctgtcaccaaggcaactaatcacattttaaaactgttcggcatataacatattcttaaagtaagaaaaaaaaggtcacagaatagcatctcttttacctgggcttgtgactgagcttaggttttagggcccatattttgtttaaaccagatagtttcatggtcttccattcaggacattttgtgtaaaaattgaggttaatttgctgggcacagtggctcacgcctgtaatcccagcactttgggaggcctaggcgggcggatcacgaggtcaggagttcgagaccatcatggctaacacggtgaaaccccgtctctactaaaaatacaaaaaattagctgggcatggtggcaggcgcctgtagtcccagctactcaggaggctgaggcaggagaatggcatgaacctgggaggtggagcttgcagtgagccgagatagcgccactgcactccagcctgagcgacagagcgagactccttctcaaaaaaaaaaaaaaaaaaaattgaggttaaagaataaattaaagataagaaatggaaattaaaatgatttgttctacagtatatacctgagaagagtgatttctgtgatcaaagagttcaattcagatttattcagaaagagctactcagaagctctatagttcgtgagctacttgatattttctagagatcattttatgttaagctgttatacattgttgatgatgtcatagaagtaggaaagaagcctttataatacagttttatgaaagaaatgggagccttttttcccatttatgatattaaaaacaacacaggtatttggtgtttagtctcaaaaatttgtttggtcaccttagtgattcttaggtacaaagtcttcatcactcaattttaacaaagaaaatagggcttataaagttatacttttgaagcatgagttatgagctaattttaagatgtatagttttggtagagtacttttgtctcagtaaaatgaaagatttgggtaactccccaaatgccctgtaaaacaaatgggtttgtggaaggttgtggtgtcagcaaaatatatgatagaataaagagttttgtacct

SEQ ID NO: 177238 - DNA, 4235 bp, Homo sapiens
  Payload ID: 14778
  Gene Symbol: RNF14
  Gene Name: ring finger protein 14
  Uniprot ID: Q9UBS8
  ENST ID: ENST00000394520
  CDS Start-End: 310-1734
gcgcagagtcctccctatgccggcggtcgcgccagcgggatccgcctggctcagctgacagctcccgagaacggaagaggcggcgcgccggttgagcagggcgtctctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaacagagttgctgctatttgttctgtcaccaaggcaactaatcacattttaaaactgttcggcatataacatattcttaaagtaagaaaaaaaaggtcacagaatagcatctcttttacctgggcttgtgactgagcttaggttttagggcccatattttgtttaaaccagatagtttcatggtcttccattcaggacattttgtgtaaaaattgaggttaatttgctgggcacagtggctcacgcctgtaatcccagcactttgggaggcctaggcgggcggatcacgaggtcaggagttcgagaccatcatggctaacacggtgaaaccccgtctctactaaaaatacaaaaaattagctgggcatggtggcaggcgcctgtagtcccagctactcaggaggctgaggcaggagaatggcatgaacctgggaggtggagcttgcagtgagccgagatagcgccactgcactccagcctgagcgacagagcgagactccttctcaaaaaaaaaaaaaaaaaaaattgaggttaaagaataaattaaagataagaaatggaaattaaaatgatttgttctacagtatatacctgagaagagtgatttctgtgatcaaagagttcaattcagatttattcagaaagagctactcagaagctctatagttcgtgagctacttgatattttctagagatcattttatgttaagctgttatacattgttgatgatgtcatagaagtaggaaagaagcctttataatacagttttatgaaagaaatgggagccttttttcccatttatgatattaaaaacaacacaggtatttggtgtttagtctcaaaaatttgtttggtcaccttagtgattcttaggtacaaagtcttcatcactcaattttaacaaagaaaatagggcttataaagttatacttttgaagcatgagttatgagctaattttaagatgtatagttttggtagagtacttttgtctcagtaaaatgaaagatttgggtaactccccaaatgccctgtaaaacaaatgggtttgtggaaggttgtggtgtcagcaaaatatatgatagaataaagagttttgtaccta

SEQ ID NO: 177239 - DNA, 582 bp, Homo sapiens
  Payload ID: 14778
  Gene Symbol: RNF14
  Gene Name: ring finger protein 14
  ENST ID: ENST00000506938
  CDS Start-End: 70-582
gagaacggaagaggcggcgcgccggttgagcagggcgtctctaggcctggtcggctggcggcggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggagga

SEQ ID NO: 177240 - DNA, 563 bp, Homo sapiens
  Payload ID: 14778
  Gene Symbol: RNF14
  Gene Name: ring finger protein 14
  ENST ID: ENST00000513019
  CDS Start-End: 266-563
atttcccaagctggttggtgcatgggcttcctcacttttttcctcacgaagaggtctctggtctcccctctctgagcactctgagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcac

SEQ ID NO: 177241 - DNA, 815 bp, Homo sapiens
  Payload ID: 14778
  Gene Symbol: RNF14
  Gene Name: ring finger protein 14
  ENST ID: ENST00000507163
  CDS Start-End: 259-815
ggctggcggcggtgagtgggccccaggcaagggcggagggcggaactttggggttcggcactgccgggcggccggaagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagag

SEQ ID NO: 177242 - DNA, 753 bp, Homo sapiens
  Payload ID: 14778
  Gene Symbol: RNF14
  Gene Name: ring finger protein 14
  ENST ID: ENST00000515613
  CDS Start-End: 198-392
ctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagag

SEQ ID NO: 177243 - DNA, 667 bp, Homo sapiens
  Payload ID: 14778
  Gene Symbol: RNF14
  Gene Name: ring finger protein 14
  ENST ID: ENST00000506822
  CDS Start-End: 270-667
ggccggggctccggggacaggccagatgggaagctgctgtccacgcagcaaggcggctgctgagggaaagggagcctctgcatcaccaaatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaaga

SEQ ID NO: 177244 - DNA, 473 bp, Homo sapiens
  Payload ID: 14778
  Gene Symbol: RNF14
  Gene Name: ring finger protein 14
  ENST ID: ENST00000507291
  CDS Start-End: 290-473
ggaccgggctgggactgtacactgggcctcagtccctcaaatccgggaccgggcgtccgcagctcggctggccgggactcccttcgggacgctgaggaggaaggggaagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtg

SEQ ID NO: 177245 - DNA, 938 bp, Homo sapiens
  Payload ID: 14778
  Gene Symbol: RNF14
  Gene Name: ring finger protein 14
  ENST ID: ENST00000511961
  CDS Start-End: 105-938
ggaggatgaggccggggctccggggacaggccagatgggaagctgctgtccacgcagcaaggcggctgctgagggaaagggagcctctgcatcaccaagtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcag

SEQ ID NO: 177246 - DNA, 575 bp, Homo sapiens
  Payload ID: 14778
  Gene Symbol: RNF14
  Gene Name: ring finger protein 14
  ENST ID: ENST00000506004
  CDS Start-End: 530-575
agagaaggggaccgggctgggactgtacactgggcctcagtccctcaaatccgggaccgggcgtccgcagctcggctggccgggactcccttcgggacgctgaggaggaaggggaaggtgtgggccctgctccttcgggacgccccaggctggccagcagctcacacatccgcattgcgccctctgatcccagcgttggggcggatagctagcgttgggcctgcccctgttttggggcagtcgcccaaacgacgccgcacgcctagtggcgagctgaacccagactaggacacccgaagaccaaatggatagagtgagaaggaaatgggggttagcaacctgaattgagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccc

SEQ ID NO: 177247 - DNA, 670 bp, Homo sapiens
  Payload ID: 14778
  Gene Symbol: RNF14
  Gene Name: ring finger protein 14
  ENST ID: ENST00000512565
  CDS Start-End: 213-670
agggcgtctctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcgagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccg

SEQ ID NO: 177248 - DNA, 4074 bp, Homo sapiens
  Payload ID: 14779
  Gene Symbol: RNF141
  Gene Name: ring finger protein 141
  Uniprot ID: Q8WVD5
  ENST ID: ENST00000265981
  CDS Start-End: 144-836
cgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaaacacaagaaaatagagtgaggcttttttaccgtatatacataaaatacttatgaaaattagaagataatttggcattcctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtgattttagctaattgaagagattattttcctatgtaatttcacattctaatatactaaatgtttatattccttagagaactattttatattgtgcgctgggggcttgtgatgtttgtgtgctgttttaaaattcatttcaaattggactcgatttccttatatctaatatatatctgggagaaaaggctgcttgaaaatatcttttgattcagtgatttttaacattgggaagttgagtttattaaaaggtagtctg

SEQ ID NO: 177249 - DNA, 1374 bp, Homo sapiens
  Payload ID: 14779
  Gene Symbol: RNF141
  Gene Name: ring finger protein 141
  ENST ID: ENST00000528665
  CDS Start-End: 117-662
cgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggtaagttacctactgcattcatgggctgggccaaggtcagtgggatagtgtacatgaataaactttgaaaagtgcaaaaatactgtagttaagtatgagagagattttattctttagtactttgaattttatggcatgccttctactggttaaaactatttttgtttttacacctaacatttattaaatatgggggtgtaccttagttttgacacttttcttttgctgtatgaaaatttgtgcctgacttaagtctaaaatcaaacatttccctttttcctcctttttttctcctcatttctacatttattctgtgtatgtgtttagaaggaataaattcttgaatactggacctcagggaactttagagatcagctagtcaagttcattattttacaaaataagacttgagcgtttaggataatttataaaatacatacaataaactacatgtatttaatgtacagtttaatatgttttggcatatatacacacccataaaagttatgaatttttataaatggaatcatataatatgtgctttttttgtctggcttctttcattcagtctaattaccttggtatttattcatgttgtagcatgtatcaatagttcatgcctttttattgctgagtaatgtctgttatgtggataccatagcttgtttattcacctattgagggaaattagattattttccatatttatctattac

SEQ ID NO: 177250 - DNA, 743 bp, Homo sapiens
  Payload ID: 14779
  Gene Symbol: RNF141
  Gene Name: ring finger protein 141
  ENST ID: ENST00000533412
  CDS Start-End: 202-743
cagttgcccggggtggcggtggcttgtcccgcctcggggtggttctgagggacccggagagagtttttccttctctatcccaaaacggttgtttgaatattgccgccggctcagtcattcggccgccggacttagctgttggttaaatgtccagaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatg

SEQ ID NO: 177251 - DNA, 779 bp, Homo sapiens
  Payload ID: 14779
  Gene Symbol: RNF141
  Gene Name: ring finger protein 141
  ENST ID: ENST00000530156
  CDS Start-End: 157-315
acagaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtcacaggatatttctgactggatttgattcttaaaaccaatttccatgggtcagaattggcatttcagacgtgcagtgatctccgagaactgtagaattaaacctatacaggacgaagcttggcagctagaaaacagagctggaaactggcacggctgaattattttcaccgaagactttgtttcctaagaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaag

SEQ ID NO: 177252 - DNA, 5743 bp, Homo sapiens
  Payload ID: 14780
  Gene Symbol: RNF144A
  Gene Name: ring finger protein 144A
  Uniprot ID: P50876
  ENST ID: ENST00000320892
  CDS Start-End: 443-1321
gagcctcccgcgtgcccggcctctgtgcgcgctcgcgccccgcccgcgcagccgcttctccccgcgcgggctctcggcaggcgggaggcggcagggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacaacaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatcaaagaaggattagaaaccgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgtattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgtccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattggcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtattgcaaaagttagaagtcattttacaaattaaaaaaacatttttttcttggtagtctttaaaaattaggggattgaaaggatccaggatgggctttgtgtgtgtgtctcagattctcatttattagtgagcacacctgtgtatatatataaatcacaaggagatcatcaagggaaaacattttgcatgtgtaaagcttcatgaagttctctttaaaaaataccaaagcttgtttatttctgataattaacctaagcccttatgaaaataaacaaaatgaagggattatgacaggtattaccaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgtattgtgtcttacgtagtttgtccccccctttagcagggattcctttttaaagctattttggctggaatacaggtgacttttgtaaaccc

SEQ ID NO: 177253 - DNA, 392 bp, Homo sapiens
  Payload ID: 14780
  Gene Symbol: RNF144A
  Gene Name: ring finger protein 144A
  ENST ID: ENST00000433456
  CDS Start-End: 228-392
aggaaaggttgcatcagtttatgtgatcatgttcaagtccctcgaggttggactcagaaccaagctgaatgctcaggaaacaagtaggctggttctgcagtctgagcctggaccctgtctgtttggaggctttccttctctctttgtgaatattctctttagaagagagctctctttctgcacctgtggggatcatcaccaccatgtcagaactgaactgttctgcgatgaccacaacaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatc

SEQ ID NO: 177254 - DNA, 805 bp, Homo sapiens
  Payload ID: 14780
  Gene Symbol: RNF144A
  Gene Name: ring finger protein 144A
  ENST ID: ENST00000432850
  CDS Start-End: 1-794
ggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatcaaagaaggattagaaaccgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacagggtgatgccatcttagagaaatgcattctccataatactgaatctgagtgtcatctgtaagaggtgggttg

SEQ ID NO: 177255 - DNA, 564 bp, Homo sapiens
  Payload ID: 14780
  Gene Symbol: RNF144A
  Gene Name: ring finger protein 144A
  ENST ID: ENST00000416587
  CDS Start-End: 400-564
gtgaaaacctccacttatagcggctgcataagcttaactgcgcagagctatactgctttttgaaatactaacttgcaagttcagcaacagctaagaaaacaatcctagacttggaaattgaaagattggaagagaagtggagggattcctttggaaccctttacgtacgtatgtgtaaggaattgtaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacaacaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatc

SEQ ID NO: 177256 - DNA, 5036 bp, Homo sapiens
  Payload ID: 14781
  Gene Symbol: RNF144B
  Gene Name: ring finger protein 144B
  Uniprot ID: Q7Z419
  ENST ID: ENST00000259939
  CDS Start-End: 318-1229
gagctgtgccccacgctcccgctgcaacagtcccgggcatcgcagctgccagtcaaggctaggaggcggtcggggactccgcctcctcccgacccgtaggtctgggagcgcaagtcctgttgcagtcttgcaaagtgtaaagctgtcagccgcagagcacggaggaaagacggagagaatggaagagctcctgtccggtgtgccagcagcccggactggcggtgagcgcgagggaggctactgagaagcccggcgacggaggaacgcaggtctgctgccagggattgaggagactgaagaatgctgaagacaggctgatgggctcagctggtaggctccactatctcgccatgactgctgaaaatcccactcctggagacctggctccggcccccctcatcacttgcaaactctgcctgtgtgagcagtctctggacaagatgaccacactccaggaatgccagtgcatcttttgcacagcttgcctgaaacagtacatgcagctggcaatccgagaaggatgtgggtctcccatcacttgccctgacatggtgtgcctaaaccacgggaccctgcaggaagctgagattgcctgtttggtacctgtggaccagtttcaactttatcagaggttaaaatttgaaagagaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccgagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggataatgacattttcctcagacattatgacaaagggccatgcaggaataaacttggccactcaagagcatcagtgatgtggaaccgaacacaggtggtggggattctcgtaggcttgggcatcattgccttggttacttcacccttgttactcctggcctccccatgtataatctgttgtgtctgcaagtcctgtcggggcaagaagaaaaagcacgacccatccacaacctaaagatctctgtgttcatacgccccagatatgtgagttacatgagatggcacagtgataaagccccatttagtgaccttgcctccttctccttgccaactttgaaagtgcctccgtgtccagactttgaacttgcctgccagccttcagcatcaggaaaggccaagtcctgggtgtgagtgttcctgtgtaacaagaactgggctcaacggtccagctgtttctatggagctttggggttccttgagatgaatgaacatatcattttatcatccaaaggatctcactggactgttcaacttccagccaaattcaaggagcttgcgggaacatttgatataacaaatgtgttgtcattgttggcaacatacaagataaccaagaagctggagtctgttctgtgttgatttgactgccatgagaaacacaggggaaacctgatgaggagaaggataagactgcgtaaggagaaatcctcataggagctataaagcaggctgctgatctcagcagttgatatggtggttgtgcctctgctggctactgggtgtgctgtccccatgttcccgctgtgatttggcagaaacacaataggcttctccttgtgtgatctcagcttcaagcaggtgaaactgctgtgcagagggagttgccccttcccagtaaaagagttgcagcctgttaaacaatgtggtctaatttagtgtctctcccttggcaaatgtaagttttctaagttggccaacttgtctcttacagccagtggctgtggtctacagaattgtttcatataaaatacgggtagagtggtagagtttcaaaactttcgtcatagatatctgggacctttctcaggatctgtgttcacacagccaatagatttggaatcaggcctaagagtacacatggagggtaaatattaaagtgcgtattatgtacatctagaatccatgtgacttgcagcctacctgtaatttctatccattgagcatgcatggatatacccaatagtacacacaaaataaatgtttacttaagagccattctatccttttgtgactgaaatggtttattgtaaatctgcctaaagattttttgcatattatatatgtgaattttggttgtaagttcataacttacccaagggtatagactcataactcttttaaaacagtgcttagtacaatatcctgccatctctgtaaaaacgctaattgataaccgagtcatttacatgttttcgaacacagaatagctcttttctcagcatcattattgctctttcagcatctgttaggacagtctgaatactttctgtttcaaggcactgataaaaccgcaacaaaaacatgtaagaaataaaatagaaatgctttatataatttagtttaaatttatgtatcacctcattgtgacttattttttccattataccattagtcagatttgaataacgaggttttgaaaggataaaaccttttctccaatgacaggattatataattgctattggcaatgtagcctggtgcttcatgagacctatgctaaatgttactggagagttcttgaagccagggataccatatcaggaactattcaggatctatgatattttctgaggtaactgggtaatagaatatcaaattgctgctatctcggacctattgttaaaggatgatgctttgcctatgtaataggatatatcctaagtggggatgtgtatatttcaggaactttaattcacaagtatatattgatatctgatgtgtgtatagtacatctgttggttatgtacattttaatttacatgttgtgtagaacatagatgagaactctgggaaaacttgggaatggcaaccaaccaaaatcatttttaatcatttattagaaatttctcaatattgtgtctttttcttttgaaactctaaacacttcagaaaaaaacactatcagtgtagttcatgttagtataattatagatttacatatatttgaatagttaatttgctttgttttacacgtagcccactgcctcattataggtaaaaggcatttataactgctcaggggattacgagaactcaactgaaactgaatttttgtaacaagaatgttaatagtggcaaagtcctctgtcagtaaactctttaagcttggtgctgcaaagagtctttaaatgggggctgatttcaagtaacctaaaagactgtgttatcagaggaagaggtcccaaatttggagtaaagatgggagaaaataaatatgtgctatttccttggcgagttgagggaatttgccaccttacagagtttgtatcactgaattagctgcttttgtttttttttttttttttttgccagggctatggagtgggggttgtttgtcaaactgattttcaataattggatttaattttttttaacattgaaaagtgcctgaaaaatggtaaattcttaaatgtgtgtgagattgtcagaatcaacaaaactaggttggttaaacatatctctggtacatcaaggggcatgatacaaaccagtctaaagactgtttataaaggagagagctggcgacttatttttatttttattttttggacagagtctccctttgtcacccaggccggagtgcagtggcatgatcatggttcacttcaacccctacctcctgggctcaagtgttcctctcaccttatcctcctgagcagctgggactacaggcacacaccaccacacctggctaagttttgtattttttgtagagatggggtttctctgtgttgcccagtcttgtctcaaactcctgggctcaagcgatccacccaccttgggctcccaaagtgttgggattacaggtgtgtgtcactgtgcctgacagctgacagttttaactgacaactttgataacagaggctgctatttttgttttagataattggccagtgacagagtttacccttgcctcctttcttggtctgccagctttgtcctttctgagtgattctctttctgtattgagaggaagtgtgggtctacatagggatgtttggatgctatggcaagaatctttttgtgtttggagtgtagtccatttgcaatagaaataaaaaaatccgtcaccaaattgtaacctggatgttatagcccagcatctagaaatcctatgaaacgtattagcacaatatcttgccattgtcccatctaggaaattttttcttgttgtgaggtagggaagtgaggaggaaagccatgccgaagcaaatgttagaatcttaggcatcctatttgttcatgccatgggtatttgctttggacttggagtctgtactttgaaagaggcctttgaaaaacaaataattctgtgtgaattttcttgtagcgtgcttcatgaaaatatctacttatccaggtttgcaaatgtacatgttcatttgaatgtaaatcaccatttcttggaaccccacgttttttcttaaaaattattctgaattaaatgtatatttctttagccttccctacacagtactaataaaagacttttctttctgttcatgaatggatgcctttatgtgatatagagtcatgtgtgtatgtgtagctttaagggcaatttcagaaatgcattagatgaatgacattttataaagcgatcacaattgatatctacaggctattatgtctcatgttgattcatgatccaggaagttttatgtatttaaaaaattgctatcgtgttatatttttccaatttttggagaagaaaatagctgtttaggctctctagccacaataaatgtaagcaggaaatcaa

SEQ ID NO: 177257 - DNA, 3364 bp, Homo sapiens
  Payload ID: 14782
  Gene Symbol: RNF145
  Gene Name: ring finger protein 145
  Uniprot ID: Q96MT1
  ENST ID: ENST00000274542
  CDS Start-End: 28-2103
agactccctgtctttgcggtttgggagatgatgagaaaccacagaattgctagtagtttatgtggagatcaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataa

SEQ ID NO: 177258 - DNA, 3613 bp, Homo sapiens
  Payload ID: 14782
  Gene Symbol: RNF145
  Gene Name: ring finger protein 145
  Uniprot ID: Q96MT1
  ENST ID: ENST00000424310
  CDS Start-End: 361-2352
agagcgccgggggcgggaggagcaaacgcaggaggccatggccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataa

SEQ ID NO: 177259 - DNA, 2340 bp, Homo sapiens
  Payload ID: 14782
  Gene Symbol: RNF145
  Gene Name: ring finger protein 145
  Uniprot ID: Q96MT1
  ENST ID: ENST00000520638
  CDS Start-End: 158-2191
acttagaattttaggctctagctttgtgctcttaacattttcagtgaggcctaccatcctaaccgatggacagcccgaaaatttacttttcttaagatcagttttagttgatggtagaatttttttttttaactggttgggagaaagaaaggagataatggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggg

SEQ ID NO: 177260 - DNA, 3478 bp, Homo sapiens
  Payload ID: 14782
  Gene Symbol: RNF145
  Gene Name: ring finger protein 145
  Uniprot ID: Q96MT1
  ENST ID: ENST00000519865
  CDS Start-End: 226-2217
agtggatggccttgcgtcgcagtctgcagtaaagaggaaactagtctgaaagggaaggagaggactgtgtgtctttttattttttaaaatacggagtgtgcagttttactgaatcttgaatcatgcccaaaagaatgagctgtcggtgctgcagtcgtgacccaggctgagcggccgatggcagaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataa

SEQ ID NO: 177261 - DNA, 2658 bp, Homo sapiens
  Payload ID: 14782
  Gene Symbol: RNF145
  Gene Name: ring finger protein 145
  Uniprot ID: Q96MT1
  ENST ID: ENST00000521606
  CDS Start-End: 237-2279
gtgggaggaggtgcggggagagaggaaggggcctgtgcagtgagcaggcatcaaagattagtggatggccttgcgtcgcagtctgcagtaaagaggaaactagtctgaaagggaaggagaggactgtgtgtctttttattttttaaaatacggagtgtgcagttttactgaatcttgaatcatgcccaaaagaatgagctgtcggtgctgcagtcgtgacccaggctgagcggccgatggcagaggtagtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaag

SEQ ID NO: 177262 - DNA, 2603 bp, Homo sapiens
  Payload ID: 14782
  Gene Symbol: RNF145
  Gene Name: ring finger protein 145
  Uniprot ID: Q96MT1
  ENST ID: ENST00000518802
  CDS Start-End: 151-2232
attcattcatccagtcacttactccacaggggtttgagtgcctgcacttggtgctgggcacggctgagccatcccagacgccaaggagtttacagtctagtccagtcagtgacgaggttaaaacgaattctcgcatcattgctactgcgaatgcaccgggacaggatcagcccttcaaattctcccacgtggtccctgcaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagc

SEQ ID NO: 177263 - DNA, 3624 bp, Homo sapiens
  Payload ID: 14782
  Gene Symbol: RNF145
  Gene Name: ring finger protein 145
  Uniprot ID: Q96MT1
  ENST ID: ENST00000611185
  CDS Start-End: 376-2367
gggccgcgcgcaggcgcagagtgcggaagtcgggccgcggccgccgcagagcgccgccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggttatatcttaagtgtggtgctgctaacattgcccaggcagcatctggttcagctttatctatattttttgactgctctgctcctctatgctggacatcaaatttccagggactatgttcggagtgaactggagtttgcctatgagggaccaatgtatttagaacctctctctatgaatcggtttaccacagccttaataggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaagtattgcggaatgctgcagcactccttactctcttttgggtttggtcttcacggtttcttttgttgccttgggtgttctcacactctgcaagttttacttgcagggttatcgagctttcatgaatgatcctgccatgaatcggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagagcttgtggaaacacttccgtgctgtaagcctttgtttatttttattggtattccctgcttatatggcttatatgatttgccagtttttccacatggatttttggcttcttatcattatttccagcagcattcttacctctcttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaag

SEQ ID NO: 177264 - DNA, 2624 bp, Homo sapiens
  Payload ID: 14783
  Gene Symbol: RNF146
  Gene Name: ring finger protein 146
  Uniprot ID: Q9NTX7
  ENST ID: ENST00000309649
  CDS Start-End: 687-1763
gagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccgggtcggccttgcgctcggggcctgagaggggcggcggcggggtcaggggccgcacaaagaatgaaccagcagtggaagagaaaatactgtaagctggctgactgctggtgaagaaaatgctttatttttgtggcaggcatctgtgggatctgtaatagaaatatttccaagtctcctcaaaaggaaaagtctctataagaaaaactgaagacacaggagtttgctcaaagaatgctgaaatagatctccaggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaacagtttgtctcttgtttgagggtggaaagggtgtggaaacattttgacatttgtgaccaaaggtcacttaaaaagtggtggttttaattggttgttttcagcttaatcacctgctcagaaaagtttgatttttttcttagagattatttaaacagaatctataggcagtgtgtatataataaacatgtatgg

SEQ ID NO: 177265 - DNA, 2267 bp, Homo sapiens
  Payload ID: 14783
  Gene Symbol: RNF146
  Gene Name: ring finger protein 146
  ENST ID: ENST00000356799
  CDS Start-End: 186-308
gcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatgggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaacagtttgtctcttgtttgagggtggaaagggtgtggaaacattttgacatttgtgaccaaaggtcacttaaaaagtggtggttttaattggttgttttcagcttaatcacctgctcagaaaagtttgatttttttcttagagattatttaaacagaatctataggcagtgtgtatataataaacatgtatggaaataaaactaaa

SEQ ID NO: 177266 - DNA, 2369 bp, Homo sapiens
  Payload ID: 14783
  Gene Symbol: RNF146
  Gene Name: ring finger protein 146
  Uniprot ID: Q9NTX7
  ENST ID: ENST00000368314
  CDS Start-End: 425-1504
tggaactgcactctttcagagcctctgggccctaatacaaagcaagcacactctaaagaagccagaagaatgcaagcagcgaagtcgccgctccccacaggcaagagagtaccggcagacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatgatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaacagtttgtctcttgtttgagggtggaaagggtgtggaaacattttgacatttgtgaccaaaggtcacttaaaaagtggtggttttaattggttgttttcagcttaatcacctgctcagaaaagtttgatttttttcttagagattatttaaacagaatctataggcagtgtgtatataataaacatgtatggaaat

SEQ ID NO: 177267 - DNA, 843 bp, Homo sapiens
  Payload ID: 14783
  Gene Symbol: RNF146
  Gene Name: ring finger protein 146
  ENST ID: ENST00000480444
  CDS Start-End: 420-548
gaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccgggtcggccttgcgctcggggcctgagaggggcggcggcggggtcaggggccgcacaaagaatgaaccagcagtggaagagaaaatactgtaagctggctgactgctggtgaagaaaatgctttatttttgtggcaggcatctgtgggatctgtaatagaaatatattggagtaattcaagattctgtggttggcccttttgactgctctctctacaggtttaatttgggcatttactcattttcatggctccaaggaccatgtatgtgttggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagc

SEQ ID NO: 177268 - DNA, 2070 bp, Homo sapiens
  Payload ID: 14783
  Gene Symbol: RNF146
  Gene Name: ring finger protein 146
  Uniprot ID: Q9NTX7
  ENST ID: ENST00000610153
  CDS Start-End: 322-1401
agagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccgggtcggccttgcgctcggggcctgagaggggcggcggcggggtcaggggccgcacaaagaatgaaccagcagtggaagagaaaatactgtaagctggctgactgctggtgaagaaaatgctttatttttgtggcaggcatctgtgggatctgtaatagaaatgatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaa

SEQ ID NO: 177269 - DNA, 762 bp, Homo sapiens
  Payload ID: 14783
  Gene Symbol: RNF146
  Gene Name: ring finger protein 146
  ENST ID: ENST00000477776
  CDS Start-End: 393-521
agctgcgggctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccggcacaaagaatgaaccagcagtggaagagaaaatactgtaagctggctgactgctggtgaagaaaatgctttatttttgtggcaggcatctgtgggatctgtaatagaaatatattggagtaattcaagattctgtggttggcccttttgactgctctctctacaggtttaatttgggcatttactcattttcatggctccaaggaccatgtatgtgttggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcc

SEQ ID NO: 177270 - DNA, 568 bp, Homo sapiens
  Payload ID: 14783
  Gene Symbol: RNF146
  Gene Name: ring finger protein 146
  ENST ID: ENST00000610162
  CDS Start-End: 542-568
agagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccgggtcggccttgcgctcggggcctgagaggggcggcggcggggtcaggggccgcacaaagaatgaaccagcagtggaagagaaaatactgtaagctggctgactgctggtgaagaaaatgctttatttttgtggcaggcatctgtgggatctgtaatagaaatatttccaagtctcctcaaaaggaaaagtctctataagaaaaactgaagacacaggagtttgctcaaagaatgctgaaatagatctccaggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcat

SEQ ID NO: 177271 - DNA, 607 bp, Homo sapiens
  Payload ID: 14783
  Gene Symbol: RNF146
  Gene Name: ring finger protein 146
  ENST ID: ENST00000609447
  CDS Start-End: 298-426
gtgacggccgcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatatattggagtaattcaagattctgtggttggcccttttgactgctctctctacaggtttaatttgggcatttactcattttcatggctccaaggaccatgtatgtgttggggatcttcaatattcatgttattttctcctttggtcttatatgattgttacctttatgaagctttagtgattacaaagcactttttttgtccatttttacctgagctttgtaaactctgatttgcaggtaaggaaatttagactaatggtttaactgagtgcctaagagcacataattaataaaggactctaaaactcagatttttagatttcttgtctagcattcatttcactgtataatagctgccatgattcaaggtatccttttcccctcactggatgcagcttttcattatatagt

SEQ ID NO: 177272 - DNA, 2169 bp, Homo sapiens
  Payload ID: 14783
  Gene Symbol: RNF146
  Gene Name: ring finger protein 146
  Uniprot ID: Q9NTX7
  ENST ID: ENST00000608991
  CDS Start-End: 424-1500
agagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaataaaattgccatctttttgagccttgtctattgaggaaccaagaacacagaaaaggcagtaaaaagaaaaaaaaggattgtttgaagattgaatgtgctgtgatgatagcctaggattattgtttttcaatttttgatgagcgggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaa

SEQ ID NO: 177273 - DNA, 884 bp, Homo sapiens
  Payload ID: 14783
  Gene Symbol: RNF146
  Gene Name: ring finger protein 146
  ENST ID: ENST00000476956
  CDS Start-End: 479-601
agacagcggcgcgagacaggggcagaacgatgaggcgccggagttagctcgccggtgcgggtgcgggtgcgcggcgcgtcgcggcccctcctccgcgacgcgccgggtggtcacgtgacggccgcgcgcgttcccggcagctgcgggctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccgggtcggccttgcgctcggggcctgagaggggcggcggcggggtcaggggccgcacaaagaatgaaccagcagtggaagagaaaatactgtaagctggctgactgctggtgaagaaaatgctttatttttgtggcaggcatctgtgggatctgtaatagaaatgggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaaga

SEQ ID NO: 177274 - DNA, 516 bp, Homo sapiens
  Payload ID: 14783
  Gene Symbol: RNF146
  Gene Name: ring finger protein 146
  ENST ID: ENST00000609944
  CDS Start-End: 474-516
gctccgaggccagagagaaaagactgcgaggtggccgcagctgtggccggagaggtgggagtcggagcgaggccctctcgggggagcagggtgaacgccggccactctaggatcctcactcggggagaggaggcatagctcgcggtgtcacctccagccgcaacgtactccggcacaaagaatgaaccagcagtggaagagaaaatactgtaagctggctgactgctggtgaagaaaatgctttatttttgtggcaggcatctgtgggatctgtaatagaaatatttccaagtctcctcaaaaggaaaagtctctataagaaaaactgaagacacaggagtttgctcaaagaatgctgaaatagatctccagatattggagtaattcaagattctgtggttggcccttttgactgctctctctacaggtttaatttgggcatttactcattttcatggctccaaggaccatgtatgtgttggggatcttcaatattcatgttattttctcctttgg

SEQ ID NO: 177275 - DNA, 2077 bp, Homo sapiens
  Payload ID: 14783
  Gene Symbol: RNF146
  Gene Name: ring finger protein 146
  Uniprot ID: Q9NTX7
  ENST ID: ENST00000616343
  CDS Start-End: 137-1216
caagcagcgaagtcgccgctccccacagcacaaagaatgaaccagcagtggaagagaaaatactgtaagctggctgactgctggtgaagaaaatgctttatttttgtggcaggcatctgtgggatctgtaatagaaatgatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaacagtttgtctcttgtttgagggtggaaagggtgtggaaacattttgacatttgtgaccaaaggtcacttaaaaagtggtggttttaattggttgttttcagcttaatcacctgctcagaaaagtttgatttttttcttagagattatttaaacagaatctataggcagtgtgtatataataaacatgtatgg

SEQ ID NO: 177276 - DNA, 1304 bp, Homo sapiens
  Payload ID: 14784
  Gene Symbol: RNF148
  Gene Name: ring finger protein 148
  Uniprot ID: Q8N7C7
  ENST ID: ENST00000434824
  CDS Start-End: 218-1135
gtaccaatcacaagtcttgttattttgtttcattatgagaaagataatctactaaatattaaaatactggaaggagcaagatagctttgatccagggagaccttttccatttatgtgctttagtaatctgccgccaacaagctatcttctttatgttcttctacaactgatgttgttttgttttctcatgtttgtctcttaatagacaaatggaggcatgagcttccttagaattaccccttcgacgcatagttctgtttcatctggacttttgaggcttagtatctttctactacttagctttcctgactcaaacggaaaagccatttggacagctcacctgaatataacatttcaggttggaaatgagatcacatcggaattaggagagagtggagtgttcgggaatcattctcctctggaaagggtgtctggtgtggtggcacttcctgaaggatggaatcagaatgcctgtcatcctttgaccaatttcagcaggcccaaacaggcagactcatggctggccctcatcgaacgtggaggctgtacttttacacataaaatcaacgtggcagcagagaagggagcaaatggggtgatcatctacaactatcaaggtacgggcagtaaagtatttcccatgtctcaccaggggacggaaaatatagtcgcggtgatgataagcaacctgaaaggcatggaaattttgcactcgattcagaaaggagtctatgtgacagtcatcattgaagtggggagaatgcacatgcagtgggtgagccattacatcatgtatctatttaccttcctggctgccacaattgcctacttttacttagattgcgtctggagacttacacctagagtgcccaattctttcaccaggaggcgaagtcaaataaagacagatgtgaagaaagctattgaccagcttcaactgcgagttctcaaagaaggggatgaggaattagacctaaatgaagacaactgtgttgtttgctttgacacatacaaaccccaagatgtagtacgcattttaacttgcaaacattttttccataaggcatgcattgacccctggcttttagcccataggacatgtcccatgtgcaagtgtgacatcctgaaaacttaagaaatctggagaattttctgaagatgtaaccagatctttccaaatacaaagattagataaattgtcttattgtactttatgtagagagaaaatttcagcttctctacccaagtatgaacaagggtgaaatttgtgttttaaaaataaaactccttatcatgcccagcta

SEQ ID NO: 177277 - DNA, 839 bp, Homo sapiens
  Payload ID: 14784
  Gene Symbol: RNF148
  Gene Name: ring finger protein 148
  ENST ID: ENST00000447240
  CDS Start-End: 163-468
atattaaaatactggaaggagcaagatagctttgatccagggagaccttttccatttatgtgctttagtaatctgccgccaacaagctatcttctttatgttcttctacaactgatgttgttttgttttctcatgtttgtctcttaatagacaaatggaggcatgagcttccttagaattaccccttcgacgcatagttctgtttcatctggacttttgaggcttagtatctttctactacttagctttcctgactcaaacggaaaagccatttggacagctcacctgaatataacatttcaggggacggaaaatatagtcgcggtgatgataagcaacctgaaaggcatggaaattttgcactcgattcagaaaggagtctatgtgacagtcatcattgaagtggggagaatgcacatgcagtgggaggcgaagtcaaataaagacagatgtgaagaaagctattgaccagcttcaactgcgagttctcaaagaaggggatgaggaattagacctaaatgaagacaactgtgttgtttgctttgacacatacaaaccccaagatgtagtacgcattttaacttgcaaacattttttccataaggcatgcattgacccctggcttttagcccataggacatgtcccatgtgcaagtgtgacatcctgaaaacttaagaaatctggagaattttctgaagatgtaaccagatctttccaaatacaaagattagataaattgtcttattgtactttatgtagagagaaaatttcagcttctctacccaagtatgaacaagggtgaaatttgtgttttaaaaataaaactccttatcatgcc

SEQ ID NO: 177278 - DNA, 2458 bp, Homo sapiens
  Payload ID: 14785
  Gene Symbol: RNF149
  Gene Name: ring finger protein 149
  Uniprot ID: Q8NC42
  ENST ID: ENST00000295317
  CDS Start-End: 109-1311
cgcctcagtcttccagggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgacagcagtccaccatcagcctcccctgctgaatctgagccacagtgtgatcccagctttaaaggagatgcaggagaaaatacggcattgctagaagccggcaggagtgactctcggcatggaggacccatctcctagcacacgtgcccactgaagtggcaccaacagaagtttggcttgaactaaaggacattttattttttttactttagcacataatttgtatatttgaaaataatgtatattattttacctattagattctgatttgatatacaaaggactaagatattttcttcttgaagagacttttcgattagtcctcatatatttatctactaaaatagagtgtttaccatgaacagtgtgttgcttcagactattacaaagacaactggggcaggtactctaatataaaggacaggtggtgtttctaaataattggctgctatggttctgtaaaaaccagttaattctatttttcaaggtttttggcaaagcacatcaatgttagactagttgaagtggaattgtataattcaattcgataattgatctcatgggctttccctggaggaaaggttttttttgttgttttttttttaagaacttgaaacttgtaaactgagatgtctgtagcttttttgcccatctgtagtgtatgtgaagatttcaaaacctgagagcactttttctttgtttagaattatgagaaaggcactagatgactttaggatttgcatttttccctttattgcctcatttcttgtgacgccttgttggggagggaaatctgtttattttttcctacaaataaaaagctaagattctatatcgcacatgagcattaagttcttcattgccttgttaaggaaaatgagtaggcagactcagaatctgttatattgatttcagttacaatttaatctttacaattaaaagggcgaaagatgtagaattttagtttttgttgttgactcgaaataaccagttttcttgattagagtttaagcagatttaataccatgaccttgcttaaccgtttcttcttttttacttgcttgctgttcttttgggtcaaaggagcaggctaatgcaaagcttttggagactgctaagtgttaaaaagtgattaaacacacactctgctattttttcacttcttggaggtagaagtcgagtatgaggcagttattttttagagtgtggaattatagtctttccttgctcctagttattctgtatatctttactttgtaggtaaaaataaatgtttatttaaaac

SEQ ID NO: 177279 - DNA, 2010 bp, Homo sapiens
  Payload ID: 14785
  Gene Symbol: RNF149
  Gene Name: ring finger protein 149
  ENST ID: ENST00000424632
  CDS Start-End: 114-1310
gaccccgcctcagtcttccagggcggcggtgggtgtccgcttctctctgctcttcgactgcaccgcactcgcgcgtgaccctgactccccctagtcagctcagcggtgctgccatggcgtggcggcggcgcgaagccagcgtcggggctcgcggcgtgttggctctggcgttgctcgccctggccctgtgcgtgcccggggcccggggccgggctctcgagtggttctcggccgtggtaaacatcgagtacgtggacccgcagaccaacctgacggtgtggagcgtctcggagagtggccgcttcggcgacagctcgcccaaggagggcgcgcatggcctggtgggcgtcccgtgggcgcccggcggagacctcgagggctgcgcgcccgacacgcgcttcttcgtgcccgagcccggcggccgaggggccgcgccctgggtcgccctggtggctcgtgggggctgcaccttcaaggacaaggtgctggtggcggcgcggaggaacgcctcggccgtcgtcctctacaatgaggagcgctacgggaacatcaccttgcccatgtctcacgcgggaacaggaaatatagtggtcattatgattagctatccaaaaggaagagaaattttggagctggtgcaaaaaggaattccagtaacgatgaccataggggttggcacccggcatgtacaggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccatgcaagcatatttttcatagaatatgcattgacccatggcttttggatcaccgaacatgtccaatgtgtaaacttgatgtcatcaaagccctaggatattggggagagcctggggatgtacaggagatgcctgctccagaatctcctcctggaagggatccagctgcaaatttgagtctagctttaccagatgatgacggaagtgatgacagcagtccaccatcagcctcccctgctgaatctgagccacagtgtgatcccagctttaaaggagatgcaggagaaaatacggcattgctaggagccatgtgttcacatgtcatgtggaccagtatttaactgtggaaaccgcgggtggcatggagaaggaggcagtgtccgtgactgtgctgctctccgcagccccctgcctgctgtcctgtttcctcggctcctcggtgtctggactggcgttctgggtttcccagcagaaaactaaagggccagagaggtgtaaaaacacacaccacttggcaggtgatttgaagatattaaagctagaaattggaactagaaaatcaaaagaattcaaggcatcttaacgtgacagttgaactcatttgattatacttaaaaaagtttattgcagttattgactctcaattttttttttttttttttgagtgcagtggtgccattgttgctcactgcagcctcaatcttccaggctcaagaaatcctcccacctcagcttccagagtagctgggactacaggtgcatgccacaccctgataatttttttttccccaatataaacgaggtcttgctatgtcctccagtctggtcttgaactcaagtgatccacccaccttggcctcccaaagtgctgggattacaggcgtgagccaccaaacccagccaccaattttactttaggtaaacttttattttcaagcttttgttggtgttgcaagtgtaaatctgttttataaaatgttctataaatataaccactattccttgtaagctatttaaaataaattttaaagtctttcaagt

SEQ ID NO: 177280 - DNA, 4535 bp, Homo sapiens
  Payload ID: 14786
  Gene Symbol: RNF150
  Gene Name: ring finger protein 150
  Uniprot ID: Q9ULK6
  ENST ID: ENST00000306799
  CDS Start-End: 655-1845
cacacacacacggaccgcttactccgctctgcctgctcgctcccactgtccccaagcccgccccgcccgcggcaagtgcgtgcccaggcgcagccaccggcgagatcaggagcgcagcgcccgcagcctgagggaaccggcgcagggcagcagcggctgcagctggattcgcgcgccccagcgctcagtggcggcggccgggacaccctgggcagcaccccgcaccgcagcaccccagactacgagcaatcgtgcccgtccccgccggggctggagggcgcagggccgccaccctgcaagttcgtgggcccccggccacccttatgagagaaggcgaagccgggcgaaggagcaggacgctcggcagcaggactcctccgcaagccccgcgggccctctgttcccgcgccccccgggcgcccaagaagcaaaatgcaaccaccgcgctacagctgagaggggaaggggccagcgccatccgctcgcccggaatccggtccccgcggcggctgcgcgtcccggccgcggcccctccggcccgggagtgagcagcagcaggaggagaggcagcggcccggggttggccggggctggggaggagggacgggacggagggagggcgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgtagaagacatcgtggccataatgattcctgagccaaaagggaaggagatagtaagcctgctggaaagaaacatcaccgtgacaatgtacatcaccatcggaacccggaacttgcagaaatatcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttgcatctccctaggagtccaatgcttcctgtaatgaaatccactctctatgtgtgggaaaagaggcagggaggaatgaagagagctctgaatcgagaatcctagatgaaccacacgctttactaagcctcggcttcttcatctataatgtgaagggtttaataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactatggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagttt

SEQ ID NO: 177281 - DNA, 3673 bp, Homo sapiens
  Payload ID: 14786
  Gene Symbol: RNF150
  Gene Name: ring finger protein 150
  Uniprot ID: Q9ULK6
  ENST ID: ENST00000420921
  CDS Start-End: 90-983
catgtgaagattgtgcttgctttccttccatcccttagccataattgcctgtttcctgagacctcctgtacagcctatggaactgtttaatgtcttctcatgcccagcccctgaagctgatttcaccatgcccatattccctttcctcaggtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttgcatctccctaggagtccaatgcttcctgtaatgaaatccactctctatgtgtgggaaaagaggcagggaggaatgaagagagctctgaatcgagaatcctagatgaaccacacgctttactaagcctcggcttcttcatctataatgtgaagggtttaataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactatggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagttt

SEQ ID NO: 177282 - DNA, 1530 bp, Homo sapiens
  Payload ID: 14786
  Gene Symbol: RNF150
  Gene Name: ring finger protein 150
  Uniprot ID: Q9ULK6
  ENST ID: ENST00000507500
  CDS Start-End: 242-1459
cgggcgcccaagaagcaaaatgcaaccaccgcgctacagctgagaggggaaggggccagcgccatccgctcgcccggaatccggtccccgcggcggctgcgcgtcccggccgcggcccctccggcccgggagtgagcagcagcaggaggagaggcagcggcccggggttggccggggctggggaggagggacgggacggagggagggcgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagttctgccatacttaaagtgacatagccagaaggactgttgccttgtaggaattggaaaaaaatacctttcctcaaaaagaaaaaaa

SEQ ID NO: 177283 - DNA, 9805 bp, Homo sapiens
  Payload ID: 14786
  Gene Symbol: RNF150
  Gene Name: ring finger protein 150
  Uniprot ID: Q9ULK6
  ENST ID: ENST00000515673
  CDS Start-End: 35-1351
cgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttgcatctccctaggagtccaatgcttcctgtaatgaaatccactctctatgtgtgggaaaagaggcagggaggaatgaagagagctctgaatcgagaatcctagatgaaccacacgctttactaagcctcggcttcttcatctataatgtgaagggtttaataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactatggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagtttaaaaaaaaaaaaaaaaagaaaaaaaaaaagcttaaccagaaagtttctctttcagaagaaaggggaacagcccttccttatagccttctttacctcccccaaagaagagactgacctggagacctggtagtctacagatgagtgtcagagggtgtgtgtaccctctagaagcaaatgcagactgtatgtgtatttgcagatgtgcatttttctatagcaagagtctagactagcactgtccaacagaaacgtaatgcaagtcacagacataattttaaattttctactagccacattttaaagtgtaaaaagaaacaggtaaagataattttaatcatgtactttaacctaatattgtttcaacatgtcactaatgtaaattaatgacatgttttacatgcttttgtgtactaagtcttctaaatccattgtgtcttttacactcacagcacctctcaatttggatagtcacatgtggctagtggctgccaattggacaatgcaggtctagagttcctccagtattctcacaagatcccccgacccttacaaaagaaaagaaggttaaaagcttaattacctccagggagaactggacaccacccaagtcgcctaatgagaggcccagaggtccatttattttgtagtgaataaagattcaggcaccctttttaaaatttctgcttgaactttctaaccatatcattgatgtccatgaccatttgttgttactcctctgaccagttgttacttaaaactcacacaaaccatgctgatttggtgctgaaacaaaattatacccctcacttctatggcaaaccctcggactgatatgtggcacttaggagccaaagagaactccagactgaaatcacccaactttacctcaaccccttcttcttgttcatggttggtgaaagtcctttcccagtgtcccccagtcccacagctgtagtgaaaactcacgaacttgggaggaaagaatgagaaatgcaagactttatgtggccttcttgaaaaagaatctttgggggcctgtgatcatccggtctctacttggtgaattatgaccacctccaacagccagcattttactccaagtcagcatccacctgccaccccaatgctatggggaagaaaaggagcatttgcattcactcaaaataatttagggtcacctttaggaactgctacctcctatgtggctagtccctttggaagagctgagccctgactatgaatacagcttttgaacattgacttaatctctagggttagatatcccctgcagtgtcaactctggtcatctacacagggagaggtagagtctggagaaggcagaaaattaaaagcggcaaaggtacctacccatttttgacatcacatggtaatgatcagaatcatggaggcaaagctctgtccaaaaatgttcattttgttttgttttgttttgttttcttgtttttaacatttccttcatcctggtgaaatatcctggaaattcatagatctgggtttggtcatttcaaagctcaccatgcccagtggccatttcagttactgccctgacatccctgaggctaccatactctcaaaaccaaatcaatgccagtgatctaacataggattctttcttatttatgagttttgtttagatggatatttttgcagagcataaaaaattaaatgacatttagttatccattgaatgtatcaccctgacttaaaaaaaaatccttaaatcaaaacttttcaaaaaatctgggctatggagtcactccctctgtggagcgagagcccagtcttttctggtactaaggccacagaggcaatttccagtagcatttttatatcttctctaagtttcttttccttttctgtctgtatctgtttttctctgactgcctatatcttactttgtatacccatacataaattattttcccatcttctctcttcccctttttttctgatttgttttctctcttgcaagaaactctgaaataaccttcagaacacaaaaaactggaggttctatacctacagagtcattatcattattgtgattaccattgttactgttgttggtgtttttcctctttttattgtgtagcaatatccatattcacttctgatgaggcaaacctgtttactataaaccaatgtcctccctaaaggagtcagtttcattttcacttctcacatcaccagttgtatcgcaacccatcttacaaccattgccatgttttcaggcttccttgccataaatgttttctgggcaaataatggcaaagcaacaattccagaatgctgtctagatctgctttctcccaccctcagcatttgaccctcctcattcgcctgagcccccagggttaggatttcttggaaaaacttgtatactgtacctgatggaatgcccattcttcctaactacttagcacaagtgcttgctcatcgtaagtgatctgagggccactaattcctgaagactgacaaagagacacgaagagactaccctcttaagatggggatgcatggttcttcatgcagtgctcttggccaccgaggtccttcatccatgccattgcatggatgaatacgtttgatgttggcagttaaaatgggatgggagtgtcaccctgcaggaagtaagaaaagaggatggcaggatctctgatcagggagctggtcaaagcagggctggaaagcttctgtgcttaacaaaatgtgcgtgctgtccccaagtaaatgctcatccctaggtttagagctgacctgggttttggggagtttgtatttttaaggaattaaatactcatgagttaaaatactcatgattgcaaagaaggtctggattgcctgaaaaataaattaattctaagaagctaatatgagtttctcatcatcccttagctcttccttttccctccttttgtcctcactcaaccccagaccctgtgtaataggaacattaatttttaaagacccacagatcaatagccacactcttccactctacaccttttattgacaccaagttatcatcccagaactaatgaagcaagtccagatgctagacgtggccccttaatatcgagcaatttgattgcaatcctgcttgttctacaagaacctgctaaggtcagtcacatctctcttcacctgccttgagtgcttcataatcacgtggctttttcaggaatttcagtgatcaaagatcttctaattctgtgctaccactgacgtttgcacttaatacagagccatttgctctgtggccacctgataaatatttgctgatgataagacaaaaatatacacgtctattaagaggtctgcaatgtctgaacacagtgagggagaaaaatccttagagaaggtcgcttaatctcaattacccaaagtcattgcttggcagaatatctgtggtctgttatccttagtgaagtgacaggcttggagaagcagggtaatgtggggaccatgtgtgctatataaaccaaagactgatcaccatccaaatgaacacatgtttcttccattgactagttgaattttctcccaatgttctcataaataaaagcgaaggtgggttgcatggttgaatgaaaccattaaaccttatggggttttctgttgcagactgttgattgaccttactaaatcccgaaatctaaaaaatgaattgtggccttagtaccacaccatctttaaagtctagtgtttagtccccttttccttcaaaactttccaacaaatctagcgctttactgaactcagaacattgttctctttgagaatgtgaagattttaaatagccaaagaattttcatgtataagagctagctaaatatagtatatcctgctctttcgaagaagatacaaaactgttgcctgtactaatgggtatagtagagcagttgaagaactaacacatacatggacttttcggtctgaatttgtgttggcatccatggtacttactgttcagtaggatgttattgcaaggagcagagtgccctctgctggagtaatcgcaattattcttgcagcagattaatttgacttgggtcatgaattcaacaaccagttacttgcctttcatcatacaatttcttcggtagttgagaatttggtctacatttatcaaatgaggaaagagtgtcacaaactctaaaaagctgaaggagaccccacagatcttctcactgtcagcagcccttacttctgcaaaatgttgaaggataatgttgctctgtttgcaaagaagatgcctctggctagaatgtttgtgcagttataagcaagggactgcttgtttttgtaagttatctcaactttattcttgtgaaattgcaaaggaagatcaataaaaagacttcatatgaatgtaaatggtgtgaaatactgatgtgttttgtacatgtacataatatatttacttcctgctttcacattagtaatctgagatggttctaccattttataattagaaggagatgtaggggtgggagtggggagggactgttatttttatagaggggtgtcccttacatttagaaaatgaaataattttgtatttgtgaaaagttacattccatccattttctggaaaaaaaaatgggtattgttctttaaaatgttcatgagctgggaggatgattattctggtttccaggggaaactctcaagcagtacatatgtgatactcagttttgtagactgcagacaataaccagcaattgccagttgcaaaaatgtgaaaaagaaataacttattttaaccactttgtacagcatattatttcccactagaaaaaaatctgcaaataatgaatttacaattataaataatcagacatgacatcataaatcaatcttcctccctactagcaagaggaaattccaatggctttttttccatcctaacacaaattacttttattgtaaacaaatgcttgcaacaaaatgcttttgttgtaaaatgattgatgttggggtaaagtctacttagcttccccacaaggtctttctggctagtctgcaggtagtagatgatggttccatctcggcattgtctatcctctccatattcagactgtgtgactgagcttccttgatttatatagcatctgacccaaaatcacaaaaaagtcactcctgatgacatttgcatggggagtctttcatttggacttcagttcttaattgccgaaataagtactagtgaattatgtagcgtttttacccaaaactaatcttctgtacaaagttgtgtgcatattgagatgattagttaaggcagtgtagttttttaaattttttctgtataaatttctttccttcttccccacctcaggcacctaccctactcctttcagagcactttatatccctcttgaaatacaaagaaattgaaaaaaaaaaaaaagtaactgtctttaaaggaatttgtcttctattaggagacacagacttttattttgctttattctattctctttgtacttggagagcgtaatcaacttgtctcataatgggctagtgatgaaacaagggtgatagttggaaacagtcattacaacatggttatttttgttatatagaagactatcatgtaaataagtgcaatcgtgttcttacgtactggctaaaaaaaaaatattgcaactataaggatttttaaatgagggttgtgaattccaggaaatttcactgcaaaatttcttttggttttgttttttaataaaatggaaccaga

SEQ ID NO: 177284 - DNA, 793 bp, Homo sapiens
  Payload ID: 14786
  Gene Symbol: RNF150
  Gene Name: ring finger protein 150
  ENST ID: ENST00000506101
  CDS Start-End: 103-793
aggacagaattcttcaatgggtctgaaatatgagagagtttcctggaagcagagaaaccacacaaatttacttcacactgtgtagaagacatcgtggccataatgattcctgagccaaaagggaaggagatagtaagcctgctggaaagaaacatcaccgtgacaatgtacatcaccatcggaacccggaacttgcagaaatatgtgagccgcacttcggttgtgtttgtctccatctccttcattgtcctgatgatcatttccctcgcatggctcgtcttttattacatccagaggtttcgatatgcaaatgccagggataggaaccagcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaaca

SEQ ID NO: 177285 - DNA, 786 bp, Homo sapiens
  Payload ID: 14787
  Gene Symbol: RNF151
  Gene Name: ring finger protein 151
  ENST ID: ENST00000321392
  CDS Start-End: 2-736
gggtggcgggtatgatctcaacctcttcgccagccctcctgacagcaacttcgtgtgctccgtctgccatggggttctcaagaggccagcaaggttgccatgcagccacatcttctgcaaaaagtgcatcctccggtggctagccagacaaaagacctgtccgtgctgtaggaaagaggtgaaaaggaaaaaggttgtccacatgaataaactccggaaaaccattggccgcctggaagtcaagtgcaagaacgccgacgctggctgcatagtgacatgccccctggcccatcgcaaggggcaccaggactcatgcccctttgagctaacggcctgccccaacgagggctgcacctcgcaggtgccgcgtgggaccctggcagagcaccggcagcattgccagcaagggtcccagcagcgctgccccctgggctgcggggccaccctggacccggccgagcgtgctcgccacaactgctaccgggagctgcacaacgcctggagcgtgcgccaggagcgccgtcggcccctgctgctgtccctcctgcggcgtgtgcgctggctggaccaagccaccagtgtcgttcgtagagagctggcggagctcagcaacttcctggaggaagacaccgctctgctggagggtgccccacaggaggaggccgaggctgccccagaaggcaacgttggggctgaggtggtgggggagcccagggccaacataccttgtaaataggtaaataaaagcagacccccggcctgcctgcctctgtgcctgcggccctc

SEQ ID NO: 177286 - DNA, 853 bp, Homo sapiens
  Payload ID: 14787
  Gene Symbol: RNF151
  Gene Name: ring finger protein 151
  ENST ID: ENST00000569210
  CDS Start-End: 60-332
tgtgaaatgcaggctcctgagctctgggggcctgtggagctgctgtctagacgcagatcatgggtggcgggtatgatctcaacctcttcgccagccctcctgacagcaacttcgtgtgctccgtctgccatggggttctcaagaggccagcaaggttgccatgcagccacatcttctgcaaaaagtgcatcctccggtggctagccaggggtggggcagggctaggagagaaggcaggagaatcccatcttcagagagaaacaagtgcagccttgggacgaccagacatagctgagtttggatcgtggctctactgcttagttgctgtgtgactttagtgcaagaacgccgacgctggctgcatagtgacatgccccctggcccatcgcaaggggcaccaggactcatgcccctttgagctaacggcctgccccaacgagggctgcacctcgcaggtgccgcgtgggaccctggcagagcaccggcagcattgccagcaagggtcccagcagcgctgccccctgggctgcggggccaccctggacccggccgagcgtgctcgccacaactgctaccgggagctgcacaacgcctggagcgtgcgccaggagcgccgtcggcccctgctgctgtccctcctgcggcgtgtgcgctggctggaccaagccaccagtgtcgttcgtagagagctggcggagctcagcaacttcctggaggaagacaccgctctgctggagggtgccccacaggaggaggccgaggctgccccagaaggcaacgttggggctgaggtggtgggggagcccagggccaacataccttgtaaataggtaaataaaagcagacccccggc

SEQ ID NO: 177287 - DNA, 796 bp, Homo sapiens
  Payload ID: 14787
  Gene Symbol: RNF151
  Gene Name: ring finger protein 151
  Uniprot ID: Q2KHN1
  ENST ID: ENST00000569714
  CDS Start-End: 9-746
cgcagatcatgggtggcgggtatgatctcaacctcttcgccagccctcctgacagcaacttcgtgtgctccgtctgccatggggttctcaagaggccagcaaggttgccatgcagccacatcttctgcaaaaagtgcatcctccggtggctagccagacaaaagacctgtccgtgctgtaggaaagaggtgaaaaggaaaaaggttgtccacatgaataaactccggaaaaccattggccgcctggaagtcaagtgcaagaacgccgacgctggctgcatagtgacatgccccctggcccatcgcaaggggcaccaggactcatgcccctttgagctaacggcctgccccaacgagggctgcacctcgcaggtgccgcgtgggaccctggcagagcaccggcagcattgccagcaagggtcccagcagcgctgccccctgggctgcggggccaccctggacccggccgagcgtgctcgccacaactgctaccgggagctgcacaacgcctggagcgtgcgccaggagcgccgtcggcccctgctgctgtccctcctgcggcgtgtgcgctggctggaccaagccaccagtgtcgttcgtagagagctggcggagctcagcaacttcctggaggaagacaccgctctgctggagggtgccccacaggaggaggccgaggctgccccagaaggcaacgttggggctgaggtggtgggggagcccagggccaacataccttgtaaataggtaaataaaagcagacccccggcctgcctgcctctgtgcctgcggccctc

SEQ ID NO: 177288 - DNA, 9501 bp, Homo sapiens
  Payload ID: 14788
  Gene Symbol: RNF152
  Gene Name: ring finger protein 152
  Uniprot ID: Q8N8N0
  ENST ID: ENST00000312828
  CDS Start-End: 1101-1712
gtgcacgtgcgcgcgcgcccgccccagttgcgcccccggcccgcacacaccccggctcatcttctcccggtccccttgtctcgcgccttctccagccctagaagttgccccagggcccctcccgggattagagagcgctgtgaagggccagatgttgggggtcttttgtgcagacacacgcgcctggggcgcttgctcctggaaggacagcggcaggacaaagccagctggactcgtggggcgctgctcgggaagcggcggtccccaatcccgcctggggtcggggcatggcttggggagcgctgcctgggtctggagagagtagagaaatcgccaaagcagagtgacggtgacttgatgaggtgacggtgacttgatgaggtggcggtgacttgatgaggtggcggacaggggcaaacgaaagaaagatgctcgggattgccgcgctgtgtgcctgtctgcgcggctgactaggcgccccgcattcccatatgaccgggttacctggtagattttgccagtgtgtctttgccccaagatgttattccccacctgctccgatttctttctttcctagggcttactgttgctagtaggcgctctgccaccagaggggaactcgtgggcgggggagactgcggaggaggggggaggtggttatttatcctgtagagacaattaggagccgtgacgcccccttctcggccgccagccctccacacctcatctgccttgctccacctccctagtgcacccgctccagccccgtctgcccaggagggcgcttggatttccttctccgcggcgcgtatctaacccttcctgcatgtatttcactgcaggctgaagaaagctcagtctcaattgtgtttcctgcctgtcagcctcttgcctcctaaacgtgtaccatttccacttgatgtcatcacgcagaaggggtgaaagagactcggtgacagatacagaaatgaacacacctgtgagtactggatgcctgtgagcttgccattacctgcactgcaaagacacagggcggtggcctctgagaagcagctccttccccttcaccttggccttgcccttcctgctcacggtccaccatggagacgctgtcccaggactctctgctggaatgtcagatctgtttcaattactacagcccccggcgcaggcccaagttgctggactgcaagcacacctgctgttcagtgtgcctgcagcagatgaggaccagccagaaggatgtgcggtgcccctggtgccgcggtgtcaccaagctgcctcccggcttctccgtgtcgcagctcccggacgacccggaggtcctggctgtcatcgccattccacacacttccgaacacaccccggtcttcatcaaacttcccagcaatgggtgctacatgctgcccctgcccatctccaaggagcgtgcgctgctgcccggagacatgggctgccgcctgctgcccgggagccagcagaagtccgtcaccgtggtgaccatccctgctgaacagcagcctctgcaaggtggggctccccaggaggcggtggaggaggagcaggacaggcggggcgtggtgaaaagctccacctggtcgggggtgtgcactgtcatcttggtggcttgcgtcttggtcttcctcctcggcatcgtgcttcacaacatgtcttgcatttctaagcgcttcactgtgatatcctgtggctgaagagggctgcagggaagtctcttgtgggtgccaacttaggggttgagcaggttgatgatgagatcccagtgagaagatggggggcaacactgaccatttggtgctgagcgctggcctctgggttgcctcttgattaccccaagacagacacaaagggcagaaggtgcggtctcaacaagataccaggtgaattgttctgagtgttgatggcaacagcttggaagatgattgcatgcatcctcataatcatgtattcaatggactgtaatttatgatttttcaaaatcatgttacaagatagacatattctacttagacgttaaactgtacaagtgcgtacaatgtgaccttctctaaatgcggtagattcaaacaaagatgctctgtagacaagtagaattaaacctgcgaatccgtgtaaaaattcagtgaagacatgcactgctggcttctttattttttttttctttttattgaaacccagtcttcatttagttgctaaggcttttaatacattttgaatggcaccaaaacaaaataagtcaaaatggacagtcattttatttggaggaaatatttgaacaagtgtctccaatgtgttgtgttttgtcatgaaccttcattttcttcacttgtaattagagcttgctacgtgtttatggaactgaaagctcaacaggggagcaataaaccgagaaatcatgagaaatgtctaatcccatgggaaaacctgtatgccgattttcctcaagccatctcacaaaataagaatttcaaatgtaaatattgtgtatttgtgtgtgtatgtgtgtgtgtctaatttgatttacctcaggtgtttgagtctttgctgaagaatcctgggatgaagacttcattgggcatgaatgagtcaagtctctgaagcggtggccacttcttggacatcttgacccagcgagtggtctcctacacgtcacctgcaacactcgctcctcttctgtgtatttaagtcctgcattttgtaagaggcaaatggagagtaacagaagagtgtcttttctcctggttttggagtcttgcactggccatgagtgttgtgactgatggtcaacccaggcgggcattttaataaatggcctgtgattcttttttgaaagatgctcttccacaagagttaagccagttagaattcctgtttcctcttgttgatatgagagaagatctcctgtattttaacacgtttttaccaagaaaggtggcaaggtaaactaacagctcaaattcccaatataagtggaccagttcctcataaactgtcaaatgttcttaaatgtgtaatgatctatagatgctcatgaagaaagatctgctacaagtacgtgataaattcctatccctgggtgcatgtgcattcagaaatagctgtgagctttacagctctcatctaacttcttttatggaattcatgaagcaagtggtatgtgacaaggactccacttataaatataactgtttttatgttccactgaatccctgaaaatggtgaggagggtggggggaagtgaaggaaagacaagcagggctaattccaaaaagcaaggctagaaaatagccctgtgaggtcaagacaatttaatttatttacatgctgtctgttatcttcaagcagcacaaaatatgcatataaaagtgatggaattaatgtgaaataaaacaaaaatataatggctagaatacaaagctaatactgctaattggcatgagaattcaacataaaattgtgagctctgatttttcaaattgatcataaaacctttaggaaatgtatttgaaagctcaaaatagaaattaggttaaaatgccattttattgtgtaagctcttgggcattatacaacaaataatctaggatttatttggtattaataatttaggtgtcatattagctgaatactatcctctattacataacataatatactgttgggttagtgtcaatttctcaaactctcccaggctgccataatgcatgtctgacctaatttctatttctcttggaggaaaatacacacacacacacaccacagaagtgttgcattaagaatgctacatttcgaatagactttgcccttgcaattttaagctatgccatattcagattaattttgtgagtgatatctgcatatgtttctgtacagtgtgaaatgactgaccctgtagtatagtacgtgatagagttctacttgttaaagtaggttagatatagacactaatgtgtgtgatgatagtgtcctgtgtttcttagtgcaaatctgtagagtaaaaatgtccatagaacttttacttaaaaacaatcccatgctagagttgccattaagcagtgcaaaattaatcggctgtatggtagattcttgaccttaaatttaacaacaacaaccaaaatcagattttttttgtgagtcttactgacctaagaaacattgtttaaattgtttaaatggatctgcttgcagttatttgtgtacctgtttgttggggtgtgcattcttgtgtatgtgtgtgtgtgtgtgtgtgtgtgtgtgtgtgtgtgtgagagagagagagagagagagaatctcagtctcccagatagaattttataggcttaatgatgttttaatgttgcttggcatcccattgctctggcctcttctggcatttaccaatgacccttaacaaacacatctacccatgtgaccaaagtccactgacacaagaggccaggattcatacttgcacattaatgaaaagtcacaactggaaagcacagaaagagctgaaagcagcctccggtggcttcattttgtagatgagtccgttttgtaattctgcagaaagggggggatatgaacttcgcactgcagtgtcttcttgctccatcctaggtctgtctatatctctatctggctatgatcctttctagggttgatgaataccctttactgagtcaactattgctttaaagaattttttttgtaggtttatgtactcattttagttagcatctacctctctgggaaaatgaaaggagggttgacttagggatgagtatagatgttgaaagacaactatcaaaccatgtggtttgaatttttaaaattgtaaaacattggtgtccaaacctcccaccccacttgtatgtaaaggacagtgagtgttgtataaatagtaaactataagaagcatgaattttcatctttattaatgatcttgaaataaggaagagaatgcttaatatgttaagtagagccaagaatgctactaagaagcattgtctttggaaaaattttgtataatgacttggggcataagttgtgatgaaaaggcaacttggtttttggttccagtcatacttaatgatcagaaagctctaagatgttttctttaaaaatagaattaagtttaattttttgcatggcttacagattgggtcccttgaaggttaaaccatgtgatggtataacctgtgagatcttctagattggcactgttcaatagggctttctgtgatgatggaaatgctcgaaaacctgtgccgtctggtacggtagccaccaggcacattgacttttaggcagttaaaatggggttactacaagggaagaactggatttcaaattttatttaattttaattagcttaaatttaaatagccctatgtgtctagtggctgccatattgaacgatgcagttctgggtgatagcgcttggggatccagcatcaaggtattaatggagtaacagtgaggctaaggtgagagtttgtgggctagtgacatgcagttggcaaaaggcaaaacattcctttctgggcttaaaaagtatgtgatctcaagtatgacagtaaaaattcattgttgccctttggaactgttgcttatagattttaggccaaggaatgatcagtgaagcttaaagaatgctttattaagccccttttctgggatcattagctgcatgttaacctattgtccaaaaatagtagttagacagtacctgtaaaacgtttgacttgcaagctatgcatgatctgtactgtgaaattgtgtctagggtcttgtggccaaaaagtaaatgttacaggaaaaaaaaagcctaatgaaatccctgttcacttccagtatcctatccaaacttcattgctgtattagtaaggtgcaaatataagagcaagcatgttttgcagtgttcagactggttttgtttgcccttgaagttggccagcttgtcgttgtatttggtgtgggcatatgtgggcatcatttttcagatgccaaactaaaatgtaggtagtatttttagaatgagatttgacattgttttagtgtctttcttttttaagcaaaaatttcagttatccctgaaagagttgaagatttgaagctttgcacaaaagcactttttttaacagtaaaaaatactgcccatgaaatttaaagacttgaagtttactaaagctacaataattactttttagctaaataaaaggaagcagaaaattcagtttgagatatatttcctataaagaccagattcttactgataatctggtatttattccagtctagattttgattttaagagttcccatccctttatttgaaaacttatgttgtttcaaaattggttagtctgcttttcattgttttccaaatggaatatatacaaaatacatttacttcattttagcagaaatgggttgattttttttttctagaactcatcaatgtgcaagactttccttcttagcttgcctttaaaaatcatttaatttttttttttttgccaagatactaatctttctttagccttaataggaagatagaagttcaaaagttatcggtgcaaaaggagtgatacacaaaagacttcaatttctatcttttctcagaaaagtgatgctgcccaccagtcagcattttgtttccacataagaagtgtcaggtagtcagtctgtcatccctgacttagatagagaagctgttccttgacatttccatcattctcagtaaattgtcacctacaaggtaattcttaccaaaacagaaactattgagaataataagatagtcgagataattcagtagctgttttgaaagtagtagtctatttaaaaagcaacgatgttcagttgctggattttgttcaacatgagacacttatttatttatttatttatttatgagatggagttttgctcttggtgcccaggccagagtgcaatggcatgatctcagctcactgcaacctccgcctcccaggttcaagctattctcctgcctcagcctcctgagtagctgggattataggcatgcgcctccatgcccagctaattttgtattttttaaagtagagacggggtttctccatgttggtcaggctggtctccaacttctgacttcaggcgatccacccgcctcggcctcccaaagtgctgggattacaggcatgggccactgcacccagccaacatgaaacacttctaaaagataagtggaaattcaagccattgatttttctgacacaactgacttactacacacacacacacacacacaccacgatttagctgtaattggagttaaaattcagtaaaaaactgttattagtcatgttttccaatttgtgagttatacaatattggattagatgctaatttcttaactgttgctatgggctgcatacattatgtcaaactaactacctttgggagtgtctatataaacacttgaaacttttcaaatatatgaagaggtaggttctactgtatacattttattggaaagccattaatcattgaagaacttaagcaggtggggcatttaatttcttccaaataccttattttttggatctgctcaagtggttagggcgagtgcaccattattcccgaatccctgcaatttggttcccatttttctgcacaaattttcttgctcagtcgagccaatgactttttttttttttttttttttcaggattcactgcctggggtatcccactatatatatctcacctatgatgtagtggtgcttgaaatactcatctcattagctcgattttattattctaatctaaggttttttatattattcatactatgatatttttagggacaatcagtaatatttggggcagagtactgagggacctcttgaagtctgcaacagcatgcattttctttgtttttgtgggagtgcttccctgtagctgtctttgttctagaacactgctccaaatttatttccatgggatgtagggctagtagcccatgtgaaagtcttctgtaatctccttggggtgtgagttattgggttattctaacaggagttttccaaagggatggcccatttttaattcaacatttgctttttgaaaatccagaagtagacagttggatataatagtggtggaagagcatgggctgtaagcagaaggaaatagagatgacaaatgcctcttaaaggggatctagttgatacctctgttaaatagtgggagaacacagtagctggtaccttacactgtgctttaggaaaatcctatgaggatttcatttacaaatcctcataggattttctgggttgagggacaatgcaactattaagtagagggagagggagagggaaagggagacatgaagcactgggtctatgtgaagggacaggcagatatacccaaagagggagaaaatacttaataaaggaagagtatagctgcaaaacaagacatataggagctgaaggccagatatggcagaaaccagctggagaaagaagcacaggacaactaggacaacttagtcaagcacaatctgtcattccagtacggactaccaagttcaattcaggatgcttcagttgaagacatgtggggtaatgtgctcagctcatgagggtccaaggagtccccattttccctatcaccctatcctatgctcgtggtttggattgttagcacactaggcaatttcagagtccgctctagagttggttgccacgtcagtgcagacagactctagaatcctcttaaccatggaatgcaaggcctgttcctgtggatctatcctgacttgagtatgtcagtactgttgggaaaatgagttcaagaatatttcagtttatatatcctggttgccgtcatatattttttcatttcaccacttgtttgtgtttgcctcactcaacagtcatgggtgtagaagctggtttcagcttggggctgttacaaactccctacataagccatgtagctgcaatccagggttcctcccaccctacggctttagcggtgggttctctggccctcttgataacaaatactccagtctaatggctatattaatgctgctcagaggctattaactcaaatccttgatgtgtttcatttacaattatgtggattatttattttaggagctttttttttttttttttttttttttaagggccaaatagccctacagataaatgagctgctgggctgtgtagaaaatattgtccaaatgttgccaaatattgacttcgtaaaggggatatcaagctgctgtttataaatctgaatgtcttaaaagcattcttgcttgctctctctgttatagatggtgtcttagccagtcctgagttttccaatgaacccaattttaatatatggtatttttgtatgccaaactggtgtcttgtcctttgtatatgtggtaatgttgattttatgactaccgtaaaaacacatttgctatgattaaagttcataaaatgatttcaaataga

SEQ ID NO: 177289 - DNA, 682 bp, Homo sapiens
  Payload ID: 14788
  Gene Symbol: RNF152
  Gene Name: ring finger protein 152
  ENST ID: ENST00000591306
  CDS Start-End: 341-682
cgggcgcgccgggaccacccggcgatgctgtcgccgccgccgccgcctctgtagcgagcacccgagcccgccgcggagaaaggctgaagaaagctcagtctcaattgtgtttcctgcctgtcagcctcttgcctcctaaacgtgtaccatttccacttgatgtcatcacgcagaaggggtgaaagagactcggtgacagatacagaaatgaacacacctgtgagtactggatgcctgtgagcttgccattacctgcactgcaaagacacagggcggtggcctctgagaagcagctccttccccttcaccttggccttgcccttcctgctcacggtccaccatggagacgctgtcccaggactctctgctggaatgtcagatctgtttcaattactacagcccccggcgcaggcccaagttgctggactgcaagcacacctgctgttcagtgtgcctgcagcagatgaggaccagccagaaggatgtgcggtgcccctggtgccgcggtgtcaccaagctgcctcccggcttctccgtgtcgcagctcccggacgacccggaggtcctggctgtcatcgccattccacacacttccgaacacaccccggtcttcatcaaacttcccagcaatgggtgctacatgctgcccctgcccatctccaaggagcgtgcgctgctgccc

SEQ ID NO: 177290 - DNA, 4955 bp, Homo sapiens
  Payload ID: 14789
  Gene Symbol: RNF157
  Gene Name: ring finger protein 157
  Uniprot ID: Q96PX1
  ENST ID: ENST00000269391
  CDS Start-End: 134-2173
gccgcagcgccgcagcggagccggccgcggcgggcagtcggcccccgcaccgggcgcggggcgggcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaacaaaaaaaaaaaaattcaaggctgtttccaaggcagcctcaaaaagagcctggtgcccagggggtccttcgtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtga

SEQ ID NO: 177291 - DNA, 2937 bp, Homo sapiens
  Payload ID: 14789
  Gene Symbol: RNF157
  Gene Name: ring finger protein 157
  Uniprot ID: Q96PX1
  ENST ID: ENST00000319945
  CDS Start-End: 69-2042
cggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagag

SEQ ID NO: 177292 - DNA, 755 bp, Homo sapiens
  Payload ID: 14789
  Gene Symbol: RNF157
  Gene Name: ring finger protein 157
  ENST ID: ENST00000592271
  CDS Start-End: 62-280
ggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtggtatggctgtaatcagtttactcctacttggagcttaagtggccaattcaaaaaatgtaacaaaaataagtttgcagttgcttgttcagcagtttgtagcttggtctgagttgagagagatgcactagaagacaaactgcagcctccttggttgtatgggatctcttgttgctagaggactggaagagctcctggagtcttgtgagggagaggatgagtctcacaaattaagctaggacagatctctccctgtcacctctttaggcaacccttttccaagggcttaccttttttttttttcttcatggcacttaacaccaaccttttattgatttgtctctttctctgcttattgtctgcctcctcctctagaacgtaagtttcataaggcaaggactgtttttactgtagtatcccaaacctagaacaaagcctggcacgtaatgttaagcccttaataaatgattgttgaatgaatgactgaaaa

SEQ ID NO: 177293 - DNA, 2220 bp, Homo sapiens
  Payload ID: 14789
  Gene Symbol: RNF157
  Gene Name: ring finger protein 157
  ENST ID: ENST00000591615
  CDS Start-End: 1-245
acaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtaagtatttgaagaccacagactgttagtattagggtccttccttccttttattctttcctttcttcttctctctccctctttttttatttttgttttactttttgctctctccttttcctctttttttttttttaatcaaagaagaaaagaaaaaaagggagtgcttttgaatgttacaagctattacaaacgacttgggtggcctgaaaggaatgctgatttttgaggtcttcattgttccagaagtgttggtgttgagggagcctttatctgagcaaaggacttgagaaatgaaagaacaagatttatttcccaacattgggtttagggagaactctttttatttaaaatgccagagtgagaaacatttcaagcgaaaggataaagcattagggtccaatttagtgtaattagagtcattggcttaatttatccattccttttctaaaattcaaagttagccatccattctccctcttccagaatgatcagcaccttgtgcatatgtctgctagaaagtcccagcccctaccatgtgccagcacttttctttccactcttgtagaggtaggaggagacatcactgggaggagagagagtggtgccagtggcattggcaagggagggtgggtgaggggcaggtcatctcacggagggtgtagagcagctgggtaggaggcagggttgggcttcctcgagatgcaaagaaaagccttcctgtagatgggtgatagatacctgaaattctacactgttcgttcttttaggttaattactcgcctctcttttaatgaggtcaataataagaatatcttaggataaattagttttccaatataatcactgcatgaaaacaagttttaagagcagcagaggaggaaacagatcctgggctcaggcccagggcactacctgggcaggccaggccttggtgagttgcctcatgggggaaggcctggttctccaggaggcctggatgggatggaaaggctcgtgtagctagaggaagatggtttgtccattttcctcttgttagattggcattagcaacagactgttaaaacggagagtgggatataaaatcagcgacaggctatgtcttaggggaagggatggctaagaaacagaggtgaggcagaagagtgtgctcctaaaagtaaatggggcagggccaacttagacactgacatggcccaggttaatgggagtgggattgggccttggtagttggggttttaagaaacagggctggccgggcttgatggctcatctctgttatcctagcagttcgggagcctgaggcaggtggatcacttgaggtcaggagtttgagaccagcctggtcaacatggtgaaaccccgtctctaccacaaaatacaaaaattagccaggcatggtggtgcacaccctgtaatcgcagctactcaggaggctgagacaggagaatcgcttgaacccaggaggtggaggttgcagcgagccaagatggtgccactgcactccagcctggatgacagagcaagaccctatctcaaaaaaaaaaaaaaaaaaaaggaaacagggccaagaggtgtaattttgctgcatgttggggatggggtggcttcatggtgtggggtacacaccattagcctctccctcaaggtcttgctatcgccctttgcatccatattttcccttcccatctttttccttgccaacttcttcttctttttctttctcttttccattcctttatttgtataatgtctgaactcaaattggattatatagcaaatgcctagattttaatgcatgcccttccatcctttttctagtctgtgccttcttaattgtccataatagtatgctgcagtgcaagtattattattgtatttgtgaaattttatgttccctgttgtatataatgatgggtgaattaaatatttgattttctttcttctctcaaagagaaaacataagtaaataaaagcatcttttact

SEQ ID NO: 177294 - DNA, 559 bp, Homo sapiens
  Payload ID: 14789
  Gene Symbol: RNF157
  Gene Name: ring finger protein 157
  ENST ID: ENST00000591355
  CDS Start-End: 1-484
gtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctgccgcagctccggagtcctgccccataaacattgaggaataggtgcctggcaggctgatgacaatgccgtcagtcggaatgcccagcgccggcgcttgtcatccagcagcctggagg

SEQ ID NO: 177295 - DNA, 7596 bp, Homo sapiens
  Payload ID: 14790
  Gene Symbol: RNF165
  Gene Name: ring finger protein 165
  Uniprot ID: Q6ZSG1
  ENST ID: ENST00000269439
  CDS Start-End: 52-1092
acaaagggcccgcgcgcagccgccgccgccgccgccgcgcgaggagccaggatggtcctggtccacgtcggctatctcgtgcttccagtgtttggctctgtgcgaaacagaggtgccccctttcaaaggtctcagcatcctcacgctacctcctgccgccacttccacctgggccccccgcagccgcagcagctcgctcccgacttcccgctggcccaccccgtgcagtcgcagccaggcctcagcgcccacatggccccggcccaccagcacagcggcgccctgcaccagtcgctgaccccgctgcccaccctgcagttccaggacgtcacaggtccctccttcctacctcaggccctgcaccagcaatacctcctgcagcagcagctcctggaagcccagcaccgcaggctggtctcgcaccccaggcggagtcaggagcgtgtatctgtccacccccaccgcctccatcccagcttcgacttcggccaactgcagacacctcagcccaggtatttggctgagggcactgactgggatctcagtgtggatgctggcttgagtcctgctcagttccaggtgcggcccatccctcagcactatcagcattacctagccactcctcgaatgcaccactttcccagaaactcctcctccacacagatggtcgtccatgaaatccgaaactacccttaccctcagcttcacttccttgctctccagggactaaatcccagcagacacacctccgccgtacgggagagctatgaggagctgctgcagctcgaggacaggttgggtaatgtgactcggggagctgtacagaacaccattgagaggttcaccttcccccacaagtataagaagcgaagaccccaggatggcaagggcaagaaggatgagggggaggagtcagacacagatgagaaatgcacaatttgtctgtctatgctggaagatggagaagatgtgagacgcctaccctgtatgcatctctttcaccaactgtgcgtggaccagtggctcgccatgagcaagaaatgccccatctgccgagtggacattgagacacaactgggagccgacagctgagggaggaattagccagtggacaccccatttccttcaccaggtccccccacggccatagcccttgcagccaaactttgccttctgagccatttgacgtagaggaaaagcctgcaagcacattttgtggaaagaggagttggtggtatcggtgtcgagggagaggagggggttggggaggacccacctctccagaatggcgactgtccccatccgcctggctgagcaggagagagggagctggcggtgcccagcgcaagggcgggaaggaggggcccaggctgcggagaacccaggtgggatcctgaaggcactagctgacagacgggcccctcaatcctgtcctctgaaggattgtatatatacctctcgaccacgtaggaaccatgtaggggtctctagctatttctgtggatggcagccggagcatgttagcttaagaaaaatgttgtgtgtggtgctctagtcatcttgtggtggacatgtcgctattaccgaattcgcaccaaatatttctcattgagtttcttgttttggtgcctgaccgaaccaacgacagccccaatcttcccgtctttatgagagaaaaggaaaaaggaatcaaaggtggaagaaaaaaaaagccaaattctgtttacggtgaaaaaggattttgtttttcacccaatttgggaggcgggaggggggggttctcgttttatttttgtttttgtttttaccttggcttttgtttttctcatgtttacagtgcacggagtgtggaagggggtctaggagagggagagctggaaaaggagctgatggggtcttatcctggcctctgagggttcagcggaggtgaggaaggcagcagagctccagcaggtgaagggagagttcatctaggcggggctccccaggcccagggctcaacttcatggccccagctatatccccccagttccacactaaaccagggagggctcggccctcagctactggtacccaatgtgttcctgggagccgagagacccatggtcactccaactccttcctttaggctgtgctcttgcctgtcacaaagaggcaacgtagccactgcctccctatgcaaaaaattaaccagatgatgcagataagacagcataggtgatggctgcttggtcttggccacagtgctctcagccagcactaagggctgaggtcaataccgcagaccttggggaggaagctgagcatcccccgggatgtctccagtcctgacacagtccctcagagatggccctggctctgaggtcacatcagctaggtttgggaggcccctcagcttggtttgggagtgcccgtgttcctggtctctggctgcttctctgactctttgataaccttgggcaagtccctttctttctctgtgcctcagtttccttctcctttgaggggggagagagaacagtgcagccccatttccggtcctgctacctcacctagatgttgtgaggattcatattctctgtccagcgtgttctatgctctcttctgagaaccttgtggggtgtcgggatgggggtgctgggagacacagacctgatacagtatgtctttctgcaccacctcacaattttcctgaaccccaaagggagcagagagataagaggacagaagaatggagatgggaaaatccaccaaattccaacccaaacccaactttctttctccctatgtggaagacaccagattagctggaattctgccaccttcctttgtgccccaccccccactgttccctcatttgcactgctctgtaagcctccccctcacctccattcataacccagtctcaatgccctcgtatcaataagaccggggtaagggggacaggatacttgtcacatatttgaagaaattccatacagtgaaggaaatttgagtctgtattgctgctacaagggtaaaaccaggaccaatgggtaaaagtaacaggcgggcagattttggcttgaggaagagcttctagcacgactggttcatgcgggaatagctgctctggccacctgcaggcagaaagtgggggaagtggctcctggcaggagatttctcccagcactaatatcctggtgttctataaaatctttattgagtgcctaccggtgcaggcgctgggagagacaatagctttgaggagctcacaatctagctgaggagacaagacacatccaatgctgcaaaaatggtgaataacctgattcagggttagcagcaatgagtatcacagcgtccaactcagtagctccagtgtatgaaaatgtctccagggctaaaggctggagatctcaccagtggggaaagtacatctgagtcaggattttgggggaaagctagttactgatagccacaggaagttgagacttctgccccattctctccaatggctgggtgaaaaccaagaattcatcggaagatggctttggcctggaggtagctagggtggtctaggaagctcactcctctcttagtctcagtctttcattctttctgctgagactggcctgaaaggctggcaagtgggagggagtcagtggggaggccaggatagaactagagctggtgtcccaggttccagtctgggctcttcactgacaaagtgggcaacactagaaacttccctttgtctctctgggccttagtttcctcagttacaacctaaggaggttggattggatgcttgctaatttccttctgacactcacactccctaacatcaacacatcttcaaggcggcagagctgtgcgcccacccagctattgaaaaggactttctgtgggcacacactctgtttcagactgggctgggggcacacgtgctgggtgagacagtgggccctcgtcccctcccccctcccaattctctgccccaggctaatattagggactggggaggggaccaccagaggggagagggaagctgcttactttgggggtagaccctgaagcccctcctccttcccccacagatggggacaggaggtgatggggtgctcagaaccctgcagctcccacttctttagccgggcagctgtttgggggacaagagagggccagggtctgtgcttctgctcccggcactggtcagggagtctgggaagagtggagaagaggcagggtcaggcctcagcatctcacatccaccacctccaggaggggagaccactggtaagtcctcctcctgctcaactcaagggactcagaccctttcttgactgagacgcatgagtgccttctggggtgagagcagccccagggtttaagttgggcgtcctagcagctgcagcagctgtgccgccgcgggtccaccgaggacgccaatcaatcaacccaacaccacaagcttggttgggtgcaagcagagggtgagcaggggctgcccctccacctggccaggacccccttcggcacccagttgcccttggccaccacctgtggcaggactcaagctcctcttctgcaaatgttcccagcctccgtgcaagtattcttaactctttacgcctaatgaacaagcacagtttttcaatggtgaagaaaaaagcaccagactttttttctttttttcctaaagaaatcccctaagccccccgcctgtaggcgggacaaacactccctgcgtggggctgtagcaacgtctgtcaggcccccttgtgtttcatctcctgcgcgcgtagagcaaatgctagagcgatttcagctgatagaaaaacaaaaatgaaaaaaaaaacacaaaaaacaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaattttttttattactcctattacctcattttggcgttgtttctgggagtggaatgctttgcatgcattggtacgatgacaaacaactacgaatacaaaaaaaaaatttaaataaaattctgcaaactttatttcgtccgaactatcagggtgtgtgattgcaagctgtcctaccgtggtgctggcctctttggatacattccatacgaaatgcaaacctttgattctgtatgctgtgatctagtgaaaaactccaatatagtgactgtatttagcacatatataaatataatttgcacttgtcagcagactggggtaatcctttcacttgctacacttggcacccccccgcccccaccacaaccctgcctctccatcatgaacctgcctttcctcctccctcgctcctcccacaacctcagcccacccagccggtatcctctgaggaaagtcttggggcactagaggccactgtctccacctggcctccaactccagaattggagccctccagacattacaagaggaacatcagagagccaaaaagcctgacttcttagaaggagccctggactggggagccgggaggctcaggttttcaaatctgctccatgacagacgtcccaatgaccttgagcaagtcccttggcccctgagtctcagttttctgggtggggtgagtgaggagaactgggagatctttagggtcccttagattcaagtagaatgtgacacagatcccgtgggaaaccactgtgctgtgctgtctcaccttctgaggagagaagaaagagggagaaaaggcagggcatggtggctcacgcctgtaatcccagcactttgtgaggccaaggtgggcagatcacttgagatcaggagtttgagaccagcctggccaacatggtgaaaccctgtctctactaaaaatacaaaaattagctgggcgtggtggtaggcgtctgtaatcccagctactcgggaggctgaggcaggagaatggcttgaacccaggagacggaggttgcagtgagctgggagcgtgcaccactgcactctagcctgggtgataagaacaaaactcagtccaaaaaaaaaaaaaaaaaaaaagagggaaagagggagaaaggattgggaggagaaaaggagagcaaagaagaagagaagaatagagagagtgagctgagaatttgagcttgctcagagttgactttcgggagggtttttgtcctataatatgtggcatcctgtgggtgacagggaggtgagttaggtggacacgtataggacgtgccctttcataaggcttgggcagtcatttggcgagtgagctgaaatccatgtcttgttagagatagggatggggtaggcagaaaggagctccaaactatgggtttgggattggcacccctatcctatcatcacccagagtcttcattgttgagatgctgcccatggaaaacagattgggacatagattttggaatcaaggtctctgctcctggcatctcctctgtgcgtctccctctgcctttgctccctggggactgtgggcaggaggagcttcttcggaggaccgggagtgggcctccagtccccctgcccctgtagaggaataatgagggaggacatggggaagtcactgtcaaaggctggcacagctgtgagcccaatgcctctgagcgaaaaggagagagagggagttcacgcccctgagagtagccccctgagccggctgggacctggactgcctgctttcctcctgcctcttcccctttccctccttcacagcttatcctccttcttccctctttacatcactgcctttacctggtggggatgaggccccatggggaaggtgctgatgtggagggaggaagtggagaccgagattcgccatactgcccagggaggctgtgtgagaactgggctgtgtatggtccctaaagcctcaactctgccccagctgggcgatgggtgcccctctctgggcttcctgcctagcttccccttctgcctccagcctggagccttgctttccctggagacaagcccgtggagtcccccaccacactggagggagcacgaccaccacactgctgggcctggcagacaccacatctttggcagggctcctggacgggcatgccttatgctgctctgcagggtcagagtggaaaggggccctttgccctggctggcctgtgccctcacccttgagcccctccccccactccacccctggcctcggatgcggctaatttctcagccatggagccagctgcaccagccctcgagggggtaattttgttgcccctggcaagtgaaaggattatcctcagtgttgattgtccttttttgtaatcctcctgctgttctgttctgttgtgctgtgcaacattttgctacatagactattttatagcagaaagctagaagaatatttattatgaatattaaagcaatagtgcatcaatgaaaaggcggagacattaggaattgtgtaaatgcttagattcacttttggtggattttttgtactttatttataactaataaaaatgaactgcattgctaactaca

SEQ ID NO: 177296 - DNA, 4852 bp, Homo sapiens
  Payload ID: 14790
  Gene Symbol: RNF165
  Gene Name: ring finger protein 165
  Uniprot ID: Q6ZSG1
  ENST ID: ENST00000543885
  CDS Start-End: 204-668
acaaagggcccgcgcgcagccgccgccgccgccgccgcgcgaggagccaggatggtcctggtccacgtcggctatctcgtgcttccagtgtttggctctgtgcgaaacagagggatctcagtgtggatgctggcttgagtcctgctcagttccaggtgcggcccatccctcagcactatcagcattacctagccactcctcgaatgcaccactttcccagaaactcctcctccacacagatggtcgtccatgaaatccgaaactacccttaccctcagcttcacttccttgctctccagggactaaatcccagcagacacacctccgccgtacgggagagctatgaggagctgctgcagctcgaggacaggttgggtaatgtgactcggggagctgtacagaacaccattgagaggttcaccttcccccacaagtataagaagcgaagaccccaggatggcaagggcaagaaggatgagggggaggagtcagacacagatgagaaatgcacaatttgtctgtctatgctggaagatggagaagatgtgagacgcctaccctgtatgcatctctttcaccaactgtgcgtggaccagtggctcgccatgagcaagaaatgccccatctgccgagtggacattgagacacaactgggagccgacagctgagggaggaattagccagtggacaccccatttccttcaccaggtccccccacggccatagcccttgcagccaaactttgccttctgagccatttgacgtagaggaaaagcctgcaagcacattttgtggaaagaggagttggtggtatcggtgtcgagggagaggagggggttggggaggacccacctctccagaatggcgactgtccccatccgcctggctgagcaggagagagggagctggcggtgcccagcgcaagggcgggaaggaggggcccaggctgcggagaacccaggtgggatcctgaaggcactagctgacagacgggcccctcaatcctgtcctctgaaggattgtatatatacctctcgaccacgtaggaaccatgtaggggtctctagctatttctgtggatggcagccggagcatgttagcttaagaaaaatgttgtgtgtggtgctctagtcatcttgtggtggacatgtcgctattaccgaattcgcaccaaatatttctcattgagtttcttgttttggtgcctgaccgaaccaacgacagccccaatcttcccgtctttatgagagaaaaggaaaaaggaatcaaaggtggaagaaaaaaaaagccaaattctgtttacggtgaaaaaggattttgtttttcacccaatttgggaggcgggaggggggggttctcgttttatttttgtttttgtttttaccttggcttttgtttttctcatgtttacagtgcacggagtgtggaagggggtctaggagagggagagctggaaaaggagctgatggggtcttatcctggcctctgagggttcagcggaggtgaggaaggcagcagagctccagcaggtgaagggagagttcatctaggcggggctccccaggcccagggctcaacttcatggccccagctatatccccccagttccacactaaaccagggagggctcggccctcagctactggtacccaatgtgttcctgggagccgagagacccatggtcactccaactccttcctttaggctgtgctcttgcctgtcacaaagaggcaacgtagccactgcctccctatgcaaaaaattaaccagatgatgcagataagacagcataggtgatggctgcttggtcttggccacagtgctctcagccagcactaagggctgaggtcaataccgcagaccttggggaggaagctgagcatcccccgggatgtctccagtcctgacacagtccctcagagatggccctggctctgaggtcacatcagctaggtttgggaggcccctcagcttggtttgggagtgcccgtgttcctggtctctggctgcttctctgactctttgataaccttgggcaagtccctttctttctctgtgcctcagtttccttctcctttgaggggggagagagaacagtgcagccccatttccggtcctgctacctcacctagatgttgtgaggattcatattctctgtccagcgtgttctatgctctcttctgagaaccttgtggggtgtcgggatgggggtgctgggagacacagacctgatacagtatgtctttctgcaccacctcacaattttcctgaaccccaaagggagcagagagataagaggacagaagaatggagatgggaaaatccaccaaattccaacccaaacccaactttctttctccctatgtggaagacaccagattagctggaattctgccaccttcctttgtgccccaccccccactgttccctcatttgcactgctctgtaagcctccccctcacctccattcataacccagtctcaatgccctcgtatcaataagaccggggtaagggggacaggatacttgtcacatatttgaagaaattccatacagtgaaggaaatttgagtctgtattgctgctacaagggtaaaaccaggaccaatgggtaaaagtaacaggcgggcagattttggcttgaggaagagcttctagcacgactggttcatgcgggaatagctgctctggccacctgcaggcagaaagtgggggaagtggctcctggcaggagatttctcccagcactaatatcctggtgttctataaaatctttattgagtgcctaccggtgcaggcgctgggagagacaatagctttgaggagctcacaatctagctgaggagacaagacacatccaatgctgcaaaaatggtgaataacctgattcagggttagcagcaatgagtatcacagcgtccaactcagtagctccagtgtatgaaaatgtctccagggctaaaggctggagatctcaccagtggggaaagtacatctgagtcaggattttgggggaaagctagttactgatagccacaggaagttgagacttctgccccattctctccaatggctgggtgaaaaccaagaattcatcggaagatggctttggcctggaggtagctagggtggtctaggaagctcactcctctcttagtctcagtctttcattctttctgctgagactggcctgaaaggctggcaagtgggagggagtcagtggggaggccaggatagaactagagctggtgtcccaggttccagtctgggctcttcactgacaaagtgggcaacactagaaacttccctttgtctctctgggccttagtttcctcagttacaacctaaggaggttggattggatgcttgctaatttccttctgacactcacactccctaacatcaacacatcttcaaggcggcagagctgtgcgcccacccagctattgaaaaggactttctgtgggcacacactctgtttcagactgggctgggggcacacgtgctgggtgagacagtgggccctcgtcccctcccccctcccaattctctgccccaggctaatattagggactggggaggggaccaccagaggggagagggaagctgcttactttgggggtagaccctgaagcccctcctccttcccccacagatggggacaggaggtgatggggtgctcagaaccctgcagctcccacttctttagccgggcagctgtttgggggacaagagagggccagggtctgtgcttctgctcccggcactggtcagggagtctgggaagagtggagaagaggcagggtcaggcctcagcatctcacatccaccacctccaggaggggagaccactggtaagtcctcctcctgctcaactcaagggactcagaccctttcttgactgagacgcatgagtgccttctggggtgagagcagccccagggtttaagttgggcgtcctagcagctgcagcagctgtgccgccgcgggtccaccgaggacgccaatcaatcaacccaacaccacaagcttggttgggtgcaagcagagggtgagcaggggctgcccctccacctggccaggacccccttcggcacccagttgcccttggccaccacctgtggcaggactcaagctcctcttctgcaaatgttcccagcctccgtgcaagtattcttaactctttacgcctaatgaacaagcacagtttttcaatggtgaagaaaaaagcaccagactttttttctttttttcctaaagaaatcccctaagccccccgcctgtaggcgggacaaacactccctgcgtggggctgtagcaacgtctgtcaggcccccttgtgtttcatctcctgcgcgcgtagagcaaatgctagagcgatttcagctgatagaaaaacaaaaatgaaaaaaaaaacacaaaaaacaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaattttttttattactcctattacctcattttggcgttgtttctgggagtggaatgctttgcatgcattggtacgatgacaaacaactacgaatacaaaaaaaaaatttaaataaaattctgcaaactttatttcgtccgaactatcagggtgtgtgattgcaagctgtcctaccgtggtgctggcctctttggatacattccatacgaaatgcaaacctttgattctgtatgctgtgatctagtgaaaaactccaatat

SEQ ID NO: 177297 - DNA, 2011 bp, Homo sapiens
  Payload ID: 14790
  Gene Symbol: RNF165
  Gene Name: ring finger protein 165
  ENST ID: ENST00000587853
  CDS Start-End: 191-259
gctgtcccccgcggttccggcgaggccgcgccgcgctgcgctccgctcccattggctgcgcgcgcctttgtgtggcggcagctgcggccccagcgcctttgaatgtcgagaggggccgggaagggagcctttccatgggccatctggcccgcgcgcagccgccgccgccgccgccgcgcgaggagccaggatggtcctggtccacgtcggctatctcgtgcttccagtgtttggctctgtgcgaaacagagctcagtgaatggtcaactcgctgctgtgtgcgctgtgacccttctgcctccgcatttagctgtattgtgacaccctcttaaccatttcctgtctccatctgaggaaggcattgctatttaagcggcagtatcccctatctcaggccagcctagccatgggggtgagggggagtgggtgtgtgaggaagaaagaggggggctggatgcgatctccttgaaatgccaccccctctctcaatacacaattatctcttattacttggcatttcctcttaaaacgggtgtggaacattacactaggcagaaattcaaaaatgattaagaaggatgttgagcctgaaagtataattatcctgattaaatcattaccatcctcattaataccaccaatctctaaataccattgcaggatgctgattccatgttttgaaattcaaattgctcagctgcctttaaattttatttttaatactaccttctccctcaccccccccaacaaaaaaaaatccaacaacacaaattctgcccatcagttaaagtttactttcacggcaaacatgcccacaggaaattcaagggctgaggggtgagttggtctgtgggtaaaatttcgcagaatgtgataagagttcatgaccttccgatagaggatactaatgcttaactcaacaaggtcctaaaccacaatcttcttgtaaaactattagagagtttgccagcttaaatctgttctttttagtttccattgtagtagtgtaggatgtaggccatttcagaatagatgtagagaaataaccatttttgtatcttcatcttgtttagccgagtacattgcactgtaaatccctgttaagtggattccttttgccttggcttagaggctgcagcacttcatttttcagttatctgggtgactatcagttagcttcttggcagcacccaggcataactgaagattgcacttagttggaggcaaaaaatgttaaacatatgtattaaaaaaatctttgatgaaatgacagttgctgctatcccatagcctctgaaaacttggtgcaccaaggtccctggcttaagtgggagccatggccatagcgtcttaattgtttaattgtacaatgtcaagagcatctttggacatccgccctggccctcagagctgcccctttaacagccggctcccttctgctgctcgccagccagacctgcttgaaaactgaaacaaaacagcagcaataataaaagaataaggcccctactttgagggcccttccaaaataaagtcccaaatagcctccccagactgccatttggcaatctgaaaagaaagagaaaaaagaaaagaaaagaaaaaagaatcccagcaaaatggttttccattaaacaggggtagcgtgttctgctgtgctgaattacttcctgttcttattttgtgggtaattttttctgtatcaaatatccttttggttgtgtatctttttcaccttttcttgtactaaaactaaagcatgatctgtatttttttacatcccccagttgacaatgtacagcgctcggttagagatgttaccctgctgaaacgtactgtggtcgtgtagcccgggccatctgctcattgtacgctgcttttgttctgttgcccttccgaagcatggtgggcccagcctttttttttgtatcgtgtgcatgacgacattgttacacacagaatccactaatactaatatacaatctctcaataaagaactagttttcctata

SEQ ID NO: 177298 - DNA, 1049 bp, Homo sapiens
  Payload ID: 14790
  Gene Symbol: RNF165
  Gene Name: ring finger protein 165
  ENST ID: ENST00000590330
  CDS Start-End: 248-316
cgcgcctttgtgtggcggcagctgcggccccagcgcctttgaatgtcgagaggggccgggaagggagcctttccatgggccatctgtctccccgccagccgccgccccaccgccgcccgcgccccgcgctccgcctcccgccccggcggctcccgcagccccgccgccgcccgcgcccgcgccccggagccgcgccacaaagggcccgcgcgcagccgccgccgccgccgccgcgcgaggagccaggatggtcctggtccacgtcggctatctcgtgcttccagtgtttggctctgtgcgaaacagagctcagtgaatggtcaactcgctgctgtgtgcgctgtgacccttctgcctccgcatttagctgtattgtgacaccctcttaaccatttcctgtctccatctgaggaaggcattgctatttaagcggcagtatcccctatctcaggccagcctagccatgggggtgagggggagtgggtgtgtgaggaagaaagaggggggctggatgcgatctccttgaaatgccaccccctctctcaatacacaattatctcttattacttggcatttcctcttaaaacgggtgtggaacattacactaggcagaaattcaaaaatgattaagaaggatgttgagcctgaaagtataattatcctgattaaatcattaccatcctcattaataccaccaatctctaaataccattgcaggatgctgattccatgttttgaaattcaaattgctcagctgcctttaaattttatttttaatactaccttctccctcaccccccccaacaaaaaaaaatccaacaacacaaattctgcccatcagttaaagtttactttcacggcaaacatgcccacaggaaattcaagggctgaggggtgagttggtctgtgggtaaaatttcgcagaatgtgataagagttcatgaccttccgatagaggatactaatgcttaactcaacaaggtcctaaaccacaatcttcttgtaaaactattagagagtttgccagcttaaatctgttctttttagtt

SEQ ID NO: 177299 - DNA, 2904 bp, Homo sapiens
  Payload ID: 14790
  Gene Symbol: RNF165
  Gene Name: ring finger protein 165
  ENST ID: ENST00000588679
  CDS Start-End: 52-258
acaaagggcccgcgcgcagccgccgccgccgccgccgcgcgaggagccaggatggtcctggtccacgtcggctatctcgtgcttccagtgtttggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtatgatcgaaaggagaaagatacatgaccgtgtgtgtgtgtgtgtgtgtgtgtgtgtgtgtgtgtgtgtgtgtgagagagagagagagcgcgcgcgcgagagcatgcttggttttctgtggtttgctttttttgaggtatatgtgtgttttgtgttatgtgtgttttgtattcattttttgttcattagtaccgatggctggctagctgggacctgggtctctgccctatcccatgccccagcccccaccctctcgtgggcacttgcacgattttccatcccatccttttttcgtctttaaccctttttgtgcatcgcccttgtgctattgccctgctcaccccgccccccgcaactgtctttgtatgacagttgcatacacgggttcaagatgcttgggcgcgtgtgtgtgtgtgtgtgtgtgtctgtatgtgtgtgtgcatgtgtgcgagtgtgcgcgcgcgcctcggagagtcagacctgcgctgctgtgccctccttgggtccggctggagcggggcgtccggcccttgggtgttgtgctgtgtgtgaggatgaggtgggaagctgcccccacgccaggcctttgccccgggcagcggttgacaaagcagcgggccggcgcgggctttgtttttaactgtgataaatggggtgtgtttgcacggtcccctttccccacatcccctctccctcacattctgctacaacaatagcttgattttcccctcttctccccacctccactccacatttctttcattttcttttaataaaaaattcccacctcccaagcaaatccgagatgcatttagattcattttttttcttttttgtattctgcctctggactcacatttctcgtcttggaaatgtttcttctatcctctcccactccacgtctgcttaaatccctgctggctcaggccctcctccccctctccccactccctcatacacagaatgatgtcttcccttggccgaccagggctcctctaccaagtcggggtggggggtggggtcgcagggccagcgctttagtgcgccccaggggcccgattgggcaagaaaaggaaagcccagccctattttatccagcccagctgtccccagccccgcgcctctccccagaacctaaaaggcaagcttggcccccttaggcctgtttgaaccgcagttttttgtgtgatgatagaatgatgacattctgcatttatcaaatctttttttttcttcattgtgtagctcagtgaatggtcaactcgctgctgtgtgcgctgtgacccttctgcctccgcatttagctgtattgtgacaccctcttaaccatttcctgtctccatctgaggaaggcattgctatttaagcggcagtatcccctatctcaggccagcctagccatgggggtgagggggagtgggtgtgtgaggaagaaagaggggggctggatgcgatctccttgaaatgccaccccctctctcaatacacaattatctcttattacttggcatttcctcttaaaacgggtgtggaacattacactaggcagaaattcaaaaatgattaagaaggatgttgagcctgaaagtataattatcctgattaaatcattaccatcctcattaataccaccaatctctaaataccattgcaggatgctgattccatgttttgaaattcaaattgctcagctgcctttaaattttatttttaatactaccttctccctcaccccccccaacaaaaaaaaatccaacaacacaaattctgcccatcagttaaagtttactttcacggcaaacatgcccacaggaaattcaagggctgaggggtgagttggtctgtgggtaaaatttcgcagaatgtgataagagttcatgaccttccgatagaggatactaatgcttaactcaacaaggtcctaaaccacaatcttcttgtaaaactattagagagtttgccagcttaaatctgttctttttagtttccattgtagtagtgtaggatgtaggccatttcagaatagatgtagagaaataaccatttttgtatcttcatcttgtttagccgagtacattgcactgtaaatccctgttaagtggattccttttgccttggcttagaggctgcagcacttcatttttcagttatctgggtgactatcagttagcttcttggcagcacccaggcataactgaagattgcacttagttggaggcaaaaaatgttaaacatatgtattaaaaaaatctttgatgaaatgacagttgctgctatcccatagcctctgaaaacttggtgcaccaaggtccctggcttaagtgggagccatggccatagcgtcttaattgtttaattgtacaatgtcaagagcatctttggacatccgccctggccctcagagctgcccctttaacagccggctcccttctgctgctcgccagccagacctgcttgaaaactgaaacaaaacagcagcaataat

SEQ ID NO: 177300 - DNA, 747 bp, Homo sapiens
  Payload ID: 14790
  Gene Symbol: RNF165
  Gene Name: ring finger protein 165
  ENST ID: ENST00000593230
  CDS Start-End: 280-747
gggagaccgtccaaggagggcttcagcggcagaggggagaccgtccaaggagggcttcagcggcagaggggagaccatccaagggagtgagtggggactaaaattcagcctgaagttctggcctacgtctgtgtcaaaggtgccccctttcaaaggtctcagcatcctcacgctacctcctgccgccacttccacctgggccccccgcagccgcagcagctcgctcccgacttcccgctggcccaccccgtgcagtcgcagccaggcctcagcgcccacatggccccggcccaccagcacagcggcgccctgcaccagtcgctgaccccgctgcccaccctgcagttccaggacgtcacaggtccctccttcctacctcaggccctgcaccagcaatacctcctgcagcagcagctcctggaagcccagcaccgcaggctggtctcgcaccccaggcggagtcaggagcgtgtatctgtccacccccaccgcctccatcccagcttcgacttcggccaactgcagacacctcagcccaggtatttggctgagggcactgactgggatctcagtgtggatgctggcttgagtcctgctcagttccaggtgcggcccatccctcagcactatcagcattacctagccactcctcgaatgcaccactttcccagaaactcctcctccacacagatggtcgtccatgaaatccgaaactacccttaccctcagcttcacttccttgctctc

SEQ ID NO: 177301 - DNA, 7172 bp, Homo sapiens
  Payload ID: 14790
  Gene Symbol: RNF165
  Gene Name: ring finger protein 165
  ENST ID: ENST00000586604
  CDS Start-End: 52-138
acaaagggcccgcgcgcagccgccgccgccgccgccgcgcgaggagccaggatggtcctggtccacgtcggctatctcgtgcttccagtgtttggctctgtgcgaaacagagggatctcagtgtggatgctggcttgagtcctgctcagttccaggtgcggcccatccctcagcactatcagcattacctagccactcctcgaatgcaccactttcccagaaactcctcctccacacagatggtcgtccatgaaatccgaaactacccttaccctcagcttcacttccttgctctccagggactaaatcccagcagacacacctccgccgtacgggagagctatgaggagctgctgcagctcgaggacaggttgggtaatgtgactcggggagctgtacagaacaccattgagaggttcaccttcccccacaagtataagaagcgaagaccccaggatggcaagggcaagaaggatgagggggaggagtcagacacagatgagaaatgcacaatttgtctgtctatgctggaagatggagaagatgtgagacgcctaccctgtatgcatctctttcaccaactgtgcgtggaccagtggctcgccatgagcaagaaatgccccatctgccgagtggacattgagacacaactgggagccgacagctgagggaggaattagccagtggacaccccatttccttcaccaggtccccccacggccatagcccttgcagccaaactttgccttctgagccatttgacgtagaggaaaagcctgcaagcacattttgtggaaagaggagttggtggtatcggtgtcgagggagaggagggggttggggaggacccacctctccagaatggcgactgtccccatccgcctggctgagcaggagagagggagctggcggtgcccagcgcaagggcgggaaggaggggcccaggctgcggagaacccaggtgggatcctgaaggcactagctgacagacgggcccctcaatcctgtcctctgaaggattgtatatatacctctcgaccacgtaggaaccatgtaggggtctctagctatttctgtggatggcagccggagcatgttagcttaagaaaaatgttgtgtgtggtgctctagtcatcttgtggtggacatgtcgctattaccgaattcgcaccaaatatttctcattgagtttcttgttttggtgcctgaccgaaccaacgacagccccaatcttcccgtctttatgagagaaaaggaaaaaggaatcaaaggtggaagaaaaaaaaagccaaattctgtttacggtgaaaaaggattttgtttttcacccaatttgggaggcgggaggggggggttctcgttttatttttgtttttgtttttaccttggcttttgtttttctcatgtttacagtgcacggagtgtggaagggggtctaggagagggagagctggaaaaggagctgatggggtcttatcctggcctctgagggttcagcggaggtgaggaaggcagcagagctccagcaggtgaagggagagttcatctaggcggggctccccaggcccagggctcaacttcatggccccagctatatccccccagttccacactaaaccagggagggctcggccctcagctactggtacccaatgtgttcctgggagccgagagacccatggtcactccaactccttcctttaggctgtgctcttgcctgtcacaaagaggcaacgtagccactgcctccctatgcaaaaaattaaccagatgatgcagataagacagcataggtgatggctgcttggtcttggccacagtgctctcagccagcactaagggctgaggtcaataccgcagaccttggggaggaagctgagcatcccccgggatgtctccagtcctgacacagtccctcagagatggccctggctctgaggtcacatcagctaggtttgggaggcccctcagcttggtttgggagtgcccgtgttcctggtctctggctgcttctctgactctttgataaccttgggcaagtccctttctttctctgtgcctcagtttccttctcctttgaggggggagagagaacagtgcagccccatttccggtcctgctacctcacctagatgttgtgaggattcatattctctgtccagcgtgttctatgctctcttctgagaaccttgtggggtgtcgggatgggggtgctgggagacacagacctgatacagtatgtctttctgcaccacctcacaattttcctgaaccccaaagggagcagagagataagaggacagaagaatggagatgggaaaatccaccaaattccaacccaaacccaactttctttctccctatgtggaagacaccagattagctggaattctgccaccttcctttgtgccccaccccccactgttccctcatttgcactgctctgtaagcctccccctcacctccattcataacccagtctcaatgccctcgtatcaataagaccggggtaagggggacaggatacttgtcacatatttgaagaaattccatacagtgaaggaaatttgagtctgtattgctgctacaagggtaaaaccaggaccaatgggtaaaagtaacaggcgggcagattttggcttgaggaagagcttctagcacgactggttcatgcgggaatagctgctctggccacctgcaggcagaaagtgggggaagtggctcctggcaggagatttctcccagcactaatatcctggtgttctataaaatctttattgagtgcctaccggtgcaggcgctgggagagacaatagctttgaggagctcacaatctagctgaggagacaagacacatccaatgctgcaaaaatggtgaataacctgattcagggttagcagcaatgagtatcacagcgtccaactcagtagctccagtgtatgaaaatgtctccagggctaaaggctggagatctcaccagtggggaaagtacatctgagtcaggattttgggggaaagctagttactgatagccacaggaagttgagacttctgccccattctctccaatggctgggtgaaaaccaagaattcatcggaagatggctttggcctggaggtagctagggtggtctaggaagctcactcctctcttagtctcagtctttcattctttctgctgagactggcctgaaaggctggcaagtgggagggagtcagtggggaggccaggatagaactagagctggtgtcccaggttccagtctgggctcttcactgacaaagtgggcaacactagaaacttccctttgtctctctgggccttagtttcctcagttacaacctaaggaggttggattggatgcttgctaatttccttctgacactcacactccctaacatcaacacatcttcaaggcggcagagctgtgcgcccacccagctattgaaaaggactttctgtgggcacacactctgtttcagactgggctgggggcacacgtgctgggtgagacagtgggccctcgtcccctcccccctcccaattctctgccccaggctaatattagggactggggaggggaccaccagaggggagagggaagctgcttactttgggggtagaccctgaagcccctcctccttcccccacagatggggacaggaggtgatggggtgctcagaaccctgcagctcccacttctttagccgggcagctgtttgggggacaagagagggccagggtctgtgcttctgctcccggcactggtcagggagtctgggaagagtggagaagaggcagggtcaggcctcagcatctcacatccaccacctccaggaggggagaccactggtaagtcctcctcctgctcaactcaagggactcagaccctttcttgactgagacgcatgagtgccttctggggtgagagcagccccagggtttaagttgggcgtcctagcagctgcagcagctgtgccgccgcgggtccaccgaggacgccaatcaatcaacccaacaccacaagcttggttgggtgcaagcagagggtgagcaggggctgcccctccacctggccaggacccccttcggcacccagttgcccttggccaccacctgtggcaggactcaagctcctcttctgcaaatgttcccagcctccgtgcaagtattcttaactctttacgcctaatgaacaagcacagtttttcaatggtgaagaaaaaagcaccagactttttttctttttttcctaaagaaatcccctaagccccccgcctgtaggcgggacaaacactccctgcgtggggctgtagcaacgtctgtcaggcccccttgtgtttcatctcctgcgcgcgtagagcaaatgctagagcgatttcagctgatagaaaaacaaaaatgaaaaaaaaaacacaaaaaacaaaaaacatggcacgttgctagtttacagggttttgtgagtttaaatgccttatatttaacaatcataatttatgactaacttgtagatatcgtgggttcttatttaattatttttatagttgttttgcatttttaattataatttatttatttagaaaggatactaattttttttattactcctattacctcattttggcgttgtttctgggagtggaatgctttgcatgcattggtacgatgacaaacaactacgaatacaaaaaaaaaatttaaataaaattctgcaaactttatttcgtccgaactatcagggtgtgtgattgcaagctgtcctaccgtggtgctggcctctttggatacattccatacgaaatgcaaacctttgattctgtatgctgtgatctagtgaaaaactccaatatagtgactgtatttagcacatatataaatataatttgcacttgtcagcagactggggtaatcctttcacttgctacacttggcacccccccgcccccaccacaaccctgcctctccatcatgaacctgcctttcctcctccctcgctcctcccacaacctcagcccacccagccggtatcctctgaggaaagtcttggggcactagaggccactgtctccacctggcctccaactccagaattggagccctccagacattacaagaggaacatcagagagccaaaaagcctgacttcttagaaggagccctggactggggagccgggaggctcaggttttcaaatctgctccatgacagacgtcccaatgaccttgagcaagtcccttggcccctgagtctcagttttctgggtggggtgagtgaggagaactgggagatctttagggtcccttagattcaagtagaatgtgacacagatcccgtgggaaaccactgtgctgtgctgtctcaccttctgaggagagaagaaagagggagaaaaggcagggcatggtggctcacgcctgtaatcccagcactttgtgaggccaaggtgggcagatcacttgagatcaggagtttgagaccagcctggccaacatggtgaaaccctgtctctactaaaaatacaaaaattagctgggcgtggtggtaggcgtctgtaatcccagctactcgggaggctgaggcaggagaatggcttgaacccaggagacggaggttgcagtgagctgggagcgtgcaccactgcactctagcctgggtgataagaacaaaactcagtccaaaaaaaaaaaaaaaaaaaaagagggaaagagggagaaaggattgggaggagaaaaggagagcaaagaagaagagaagaatagagagagtgagctgagaatttgagcttgctcagagttgactttcgggagggtttttgtcctataatatgtggcatcctgtgggtgacagggaggtgagttaggtggacacgtataggacgtgccctttcataaggcttgggcagtcatttggcgagtgagctgaaatccatgtcttgttagagatagggatggggtaggcagaaaggagctccaaactatgggtttgggattggcacccctatcctatcatcacccagagtcttcattgttgagatgctgcccatggaaaacagattgggacatagattttggaatcaaggtctctgctcctggcatctcctctgtgcgtctccctctgcctttgctccctggggactgtgggcaggaggagcttcttcggaggaccgggagtgggcctccagtccccctgcccctgtagaggaataatgagggaggacatggggaagtcactgtcaaaggctggcacagctgtgagcccaatgcctctgagcgaaaaggagagagagggagttcacgcccctgagagtagccccctgagccggctgggacctggactgcctgctttcctcctgcctcttcccctttccctccttcacagcttatcctccttcttccctctttacatcactgcctttacctggtggggatgaggccccatggggaaggtgctgatgtggagggaggaagtggagaccgagattcgccatactgcccagggaggctgtgtgagaactgggctgtgtatggtccctaaagcctcaactctgccccagctgggcgatgggtgcccctctctgggcttcctgcctagcttccccttctgcctccagcctggagccttgctttccctggagacaagcccgtggagtcccccaccacactggagggagcacgaccaccacactgctgggcctggcagacaccacatctttggcagggctcctggacgggcatgccttatgctgctctgcagggtcagagtggaaaggggccctttgccctggctggcctgtgccctcacccttgagcccctccccccactccacccctggcctcggatgcggctaatttctcagccatggagccagctgcaccagccctcgagggggtaattttgttgcccctggcaagtgaaaggattatcctcagtgttgattgtccttttttgtaatcctcctgctgttctgttctgttgtgctgtgcaacattttgctacatagactattttatagcagaaagctagaagaatatttattatgaatattaaagcaatagtgcatcaatgaaaaggcggagacattaggaattgtgtaaatgcttagattcacttttggtggattttttgtactttatttataactaataaaaatgaactgcattgctaactaca

SEQ ID NO: 177302 - DNA, 1883 bp, Homo sapiens
  Payload ID: 14791
  Gene Symbol: RNF166
  Gene Name: ring finger protein 166
  Uniprot ID: Q96A37
  ENST ID: ENST00000312838
  CDS Start-End: 97-810
ctacgatgacgtcagcgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactctgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccacttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttttaaaaaaaaaagtttaaataaaatgtctcagagcatctcta

SEQ ID NO: 177303 - DNA, 2419 bp, Homo sapiens
  Payload ID: 14791
  Gene Symbol: RNF166
  Gene Name: ring finger protein 166
  Uniprot ID: Q96A37
  ENST ID: ENST00000541206
  CDS Start-End: 1001-1387
actcccggctgctggctctctgaacaccaggctggcagtcactggaaactaggccgatagagcacccaccctgtgggtgcctcgttctgcctcctgctcctcgggcccagccgccctgccagtcgggctgggttccctcttgtgtctttcctgagtccttccggggaggacgaggctgtcttcctcccagccaaccttctgggcacctttcctctcttcccaagctctgcctgggacccttttccttcccctcagcccgtggccgtgctgtgcagccgagccccggcctggtctctggcagctcagggttcactcaggaggtgcaccatccagtcgtttccagtgtgtttgcaattatgcaacaatcgatgcaattctagaagattcttcccactccagaaagaaacccaggactctccccctcgcctggcacccacccgtctgctttctggtcactgggtttctctctgctggacgttgagcgtgagtggacccccacgacacgggtgggacgtgcttgctgtctgccctgcactgttttccaggccttccggtgcgtggtggggctgcacgcctcttcccggccgaacgccctttccatgggtgtgcacgccacgccgtctcttcatccgtttaccgacgggcacctgagctgcttccgcttctcctgccatgagtgcctgagtatgggggtcccctgaggcctccccaggtggaccatcttgccagcaccttcctcccgtgaacgggtgaagtaggcggcccccccggctcaaatccaggggtcagtgccagggatgaccctggaaatatctgctggggcgcctggttctgcggggagtgtctccagccctgcctgcaggtgccatccccgctgtgcccactctgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccacttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttt

SEQ ID NO: 177304 - DNA, 1525 bp, Homo sapiens
  Payload ID: 14791
  Gene Symbol: RNF166
  Gene Name: ring finger protein 166
  Uniprot ID: Q96A37
  ENST ID: ENST00000537718
  CDS Start-End: 73-459
gcgtttcccgacgttgccacatctcaggtgaataagttctatgaagcgctcacactagtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccacttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttttaaaaaaaaaagtttaaataaaatgtctcagagc

SEQ ID NO: 177305 - DNA, 502 bp, Homo sapiens
  Payload ID: 14791
  Gene Symbol: RNF166
  Gene Name: ring finger protein 166
  ENST ID: ENST00000562544
  CDS Start-End: 1-447
ggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactctgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagtggtggcagagcttgggggcctgggcaggggcccgcttggcgggccgggcaacacgtcaacattcttttctgttcttggcattaattattgctgtcttttttttaaaaaaaaaagtttaaataaaatgtctcagagcatc

SEQ ID NO: 177306 - DNA, 313 bp, Homo sapiens
  Payload ID: 14791
  Gene Symbol: RNF166
  Gene Name: ring finger protein 166
  ENST ID: ENST00000567408
  CDS Start-End: 1-139
catttcgtcctgcctgaaggtccaggagcagatggccaactgccccaagttcgtccccgtggtgcccacatcacagcctatccccagcaacatccccaacagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttttaaaaaaaaaagtttaaataaaatgtctcagagcatc

SEQ ID NO: 177307 - DNA, 633 bp, Homo sapiens
  Payload ID: 14791
  Gene Symbol: RNF166
  Gene Name: ring finger protein 166
  Uniprot ID: Q96A37
  ENST ID: ENST00000567844
  CDS Start-End: 74-544
agtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcac

SEQ ID NO: 177308 - DNA, 1768 bp, Homo sapiens
  Payload ID: 14791
  Gene Symbol: RNF166
  Gene Name: ring finger protein 166
  ENST ID: ENST00000568683
  CDS Start-End: 340-837
acttggcctcttcctttttctggagcaagtatttgaactcctgcaggcgccagagatctccttacctgtttcccgctacccttctccagccaggtttctgccctcggccagattgtcctgcagtgacttgcttttggccatggagtagtggctgctcagtgcctgagattgttttagcagcagaagggaccgggtccccctgctgctggcaacacagacgcttgcttacagttctctggtcctggacacctgaggtctcggcctccccaggacggcccttccagattctcaggaccgccttgccctccctgccctgtctcctaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggtaggcatcccgccagcaccgtcctcccccacgccctcctcatccaccctcctcctgctcgggcccctcgccagcctcagggtccgcagggttcagaggaagccagaaacagaagcctcgtttcaggtggccacattcccccaggttctgtgggggctgcctgcaggtggggagtgatggcagctgagtttgagtggccactagagggtgcccaggcctctcggggacatggaccgcacagggcaggtccctgcctgcccaccccacagaacccctcgagggtgagccaggcttccttctggaagctttctagagagcgcgggaaggactttcatcaacatcgaacactccagccctgtctccttttcccacccgccgcgggtcaggcacacacctggcccccgggcctgcagaccctcgcacaaactcctcactcctggtgcggcccctccctgcgccgccctgttcattcctggccctggctaacagtcctggcgatggctgtcactccctctgccagtcgtccgggacccacgctccgcctgcctcaggatggaaattgttagaggtcagggagccctggccggcctgctcacctcggaaaccccgggcttagagtccgacctgaaccagcagccatccattccgagtgcccccgtacccagcgggtgatggacacaccttcaccttctcaccccccagaggaccgtgcaggccccgagcctgtggggacagtggagctgggtccttcctgtgtcctgctggagggaggcaggaagggtggacacgcctgtgtgggtgatgggcagaggggacctctccttcctgtctccctcgagcccggtgcatctctccttcctgtctccaggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgcc

SEQ ID NO: 177309 - DNA, 1915 bp, Homo sapiens
  Payload ID: 14792
  Gene Symbol: RNF167
  Gene Name: ring finger protein 167
  Uniprot ID: Q9H6Y7
  ENST ID: ENST00000262482
  CDS Start-End: 657-1709
aggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagggactgggtcttcacttcttgggctaataaaattgtttctttgtggactaa

SEQ ID NO: 177310 - DNA, 1436 bp, Homo sapiens
  Payload ID: 14792
  Gene Symbol: RNF167
  Gene Name: ring finger protein 167
  ENST ID: ENST00000576229
  CDS Start-End: 333-1280
gaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacggccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagg

SEQ ID NO: 177311 - DNA, 589 bp, Homo sapiens
  Payload ID: 14792
  Gene Symbol: RNF167
  Gene Name: ring finger protein 167
  ENST ID: ENST00000576452
  CDS Start-End: 299-589
aggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaag

SEQ ID NO: 177312 - DNA, 1511 bp, Homo sapiens
  Payload ID: 14792
  Gene Symbol: RNF167
  Gene Name: ring finger protein 167
  Uniprot ID: Q9H6Y7
  ENST ID: ENST00000572430
  CDS Start-End: 305-1357
gtgcgagaaggggcgtaactgatttggaaaccagaggaaaggcgctgttttcaccgaattagaatcgcgggaaaatagagaagagtttgtttgaaggtctcgcgagatcgagaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcaga

SEQ ID NO: 177313 - DNA, 298 bp, Homo sapiens
  Payload ID: 14792
  Gene Symbol: RNF167
  Gene Name: ring finger protein 167
  ENST ID: ENST00000570328
  CDS Start-End: 84-298
gggagaggtggtgagcactctcgcgagatttgaaggagcggcggaggccagagggaggagagacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatgg

SEQ ID NO: 177314 - DNA, 1728 bp, Homo sapiens
  Payload ID: 14792
  Gene Symbol: RNF167
  Gene Name: ring finger protein 167
  Uniprot ID: Q9H6Y7
  ENST ID: ENST00000571816
  CDS Start-End: 501-1553
cgcccctccagctctcaggtccgacacccgctggaagccggcgcgggcgcaggcgcgcagcgcaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagggactgggtcttcacttctt

SEQ ID NO: 177315 - DNA, 552 bp, Homo sapiens
  Payload ID: 14792
  Gene Symbol: RNF167
  Gene Name: ring finger protein 167
  ENST ID: ENST00000573404
  CDS Start-End: 186-552
gagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatgg

SEQ ID NO: 177316 - DNA, 989 bp, Homo sapiens
  Payload ID: 14792
  Gene Symbol: RNF167
  Gene Name: ring finger protein 167
  ENST ID: ENST00000572382
  CDS Start-End: 1-627
cacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatggtgaggccctcactgcctgcccatgcccctctgccaccagcagccaccaggtgcttcaccttgttcctctctgcagcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagggactgggtcttcacttcttgggctaataaaattgttt

SEQ ID NO: 177317 - DNA, 1757 bp, Homo sapiens
  Payload ID: 14792
  Gene Symbol: RNF167
  Gene Name: ring finger protein 167
  Uniprot ID: Q9H6Y7
  ENST ID: ENST00000575111
  CDS Start-End: 530-1582
cgggtttccgggcacttttattaggtcgtcttctgggccaccagtgccccttccatctccacaggcagtccctccatcgctaacctttttttaaccggccttttaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcgacctcggaccacaatgccagcatggactttgcagaccttccagctctgtttggggctaccttgagccaggagggcctccaggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaagggggctcgggtgcttctggttccagacaataccttccccttgggctattacctcatccctttcacagggattgtgggactgctggttttggccatgggagcagtaatgatagctcgttgtatccagcaccggaaacggctccagcggaatcgacttaccaaagagcaactgaaacagattcctacacatgactatcagaagggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagggactgggtcttcacttctt

SEQ ID NO: 177318 - DNA, 858 bp, Homo sapiens
  Payload ID: 14792
  Gene Symbol: RNF167
  Gene Name: ring finger protein 167
  ENST ID: ENST00000575400
  CDS Start-End: 252-653
tttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcggggttccttgtggaggctcacccagacaatgcctgcagccccattgccccaccacccccagccccggtcaatgggtcagtctttattgcgctgcttcgaagattcgactgcaactttgacctcaaggtcctaaatgcccagaaggctggatatggtgccgctgtagtacacaatgtgaattccaatgaacttctgaacatggtgtggaatagtgaggaaatccagcagcagatctggatcccgtctgtatttattggggagagaagctccgagtacctgcgtgccctctttgtctacgagaaggggagaccagtatgatgtctgtgccatttgcctggatgaatatgaggatggggacaagctgcgggtactcccctgtgctcatgcctaccacagccgctgcgtggacccctggctcactcagacccggaagacctgccccatttgcaagcagcctgttcatcggggtcctggggacgaagaccaagaggaagaaactcaagggcaagaggagggtgatgaa

SEQ ID NO: 177319 - DNA, 599 bp, Homo sapiens
  Payload ID: 14792
  Gene Symbol: RNF167
  Gene Name: ring finger protein 167
  ENST ID: ENST00000576965
  CDS Start-End: 1-224
aggaaatccagcagcagatctggatcccgtctgtatttattggggagagaagctccgagtacctgcgtgccctctttgtctacgagaagggcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggagctggggcaagcagagggactgggtcttcacttcttgggctaataaaattgtttctttgtggactaa

SEQ ID NO: 177320 - DNA, 5347 bp, Homo sapiens
  Payload ID: 14793
  Gene Symbol: RNF168
  Gene Name: ring finger protein 168, E3 ubiquitin protein ligase
  Uniprot ID: Q8IYW5
  ENST ID: ENST00000318037
  CDS Start-End: 596-2311
gcttgtccggtggctgctgcgctgccgcaacgaatagggtttctggctgcgtaggagggacgggggcgcggagctctgggaaactgcgccaggcgcccgaaaggtgaacacgggagtcgcgcgtctcccccgcagcagcggtaaagcggaagttatgctgcagccggagcccgggcttcctcccggagccgcgtcccggggcccggctgccccgagctgagcggagcatcctttccgggtgaggggaggagaggacttggcgcgttcccctcgctgccccgggagccgcagccgcggtgttcatgccgcggagcagccaggctcctccgacgaaaacctgcatttatttgctggcgggacgtttgccttgaaaatggacaaagacgccgccctccggggtattcctgtttgcctgaccctgagagcgcctttttgcttcaagacgtgttggatgctcctgttctccgaattctgatacgcttctgggcataatactgaaacacaaaactgcttttgctctctctgtggttggccgaaaataggattctttttcgtgcaggtgtcgttgtttagtcggctttactaacatattgaaatggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtggctgatgactatcagccagttcgtctgctcagtaaacctggggaactgagaagagaatatgaagaggaaataagcaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattaacaatttctgtgagggaagtatctcggcttctcccttgaattccagaaaatctgatccagttacacccaagtctgaaaagaaaagtaagaacaaacaaagaaacactggagatattcagaagtatttgacaccgaaatctcagtttgggtcagcctcacactctgaagctgtacaagaagtcaggaaagactccgtatctaaggacattgacagtagtgataggaaaagcccaacagggcaagacacagaaatagaagatatgccgacactttctccacagatatcccttggagttggagaacaaggtgcagattcttcaatagagtcccctatgccatggttatgtgcctgtggtgccgaatggtaccatgaaggaaacgtcaaaacaagaccaagcaatcatgggaaagagttatgtgtcttaagtcacgagcgacctaaaaccagagttccctactcgaaagaaactgcagttatgccttgtggcagaacagaaagtgggtgcgcccccacatcaggggtgacacagacaaatggaaacaacacaggtgagacagaaaatgaagagtcgtgcctactgatcagtaaggagatttccaaaagaaaaaaccaagaatcttcctttgaagcagtcaaggatccatgcttttctgcaaaaagaagaaaagtgtcccccgaatcttccccagatcaagaggaaacagaaataaactttacccaaaaactgatagatttggagcatctactgtttgagagacataaacaagaagaacaggacaggttattggcattacaacttcagaaggaggtggataaagagcaaatggtgccaaaccggcaaaaaggatccccagatgagtatcacttacgcgctacatcctcccctccagacaaagtgctaaatggacagaggaagaatcccaaagatgggaacttcaaaaggcaaactcacacaaagcatccaacaccagagagaggctcaagggacaaaaataggcaagtgtctttaaagatgcagttgaagcagtcagttaatagaagaaagatgccaaattctactagagatcactgtaaggtatccaaaagtgctcactccctacagcctagcatttcacagaaaagtgtttttcagatgtttcagagatgcacaaagtaaggcctggtaaagggagtgctttgtgatctagtaaagctggaatgtgaagctctttcctatcatggaatcttcatccatgtgtcattcatgctgctctctaggcacactcattgtccttaatgaaggtctgtgtgattgtaaggactgcatagacacatgagcttctgcacagctcagcggtaagcaggggtcccctgtcgtttcccttcttaataacagatgtgtattaagctttacaattcttagagatatcttaagctttggccaactccaggaaatcttcaagtgccattgtctttccaaaaactgcatgttttatggcctttgctcacctttttgtcgtgactggtaatcaaagcaagattatactattctgagtgattaaggaacccatgcagggtttaaaatccattttcttgctattgtccaatgtttacagagtactcaaaaggttttcctaaagtaatctaatttccatctccaatttaattcaattttcagcattgtagcatttcctttggtgtttgttttttttttttagacggagtttcaaaatttggattcatattcatatgtgggaaatcccagatttttttttttttttttttttttttttttttttggagacagagtcttgctctgtcacgcaggctggtgtgcaatggcgcgatctcagctcactgcaacctccgcctcccgagttcaagcgattcttctgcctcagcctcccgagtagctgggatcataggcatgtgccactacacccagctacccagctaatttttttttttttttgtacttttagtagagatgggatttcaccatgttggccaggctggtcttgaactcctgtcctcaggtgatccacctgcttcggcctcccagagtgctgggattataggcgtgagccaccacgcccggcctgtttcctttggtttaaagtggattcgaatcagtgttaaatcagaaaatcagggttttctaggaaattgggaattagttgccagaaaggaaactgaactatgcagaaggagttaagagctgggatgaggctggatggggtgactgacagtccagatcattgaaacagattgggtcgtcggaaactggtccagatgaggctggatggggtgactgacagtctggatcattgaaactgattaggtcgtcagaaacgggtccagacgaggatgaggctgaggctggatggggtgactgacagtctggatcattgaaactgattgggtggttggtcagaaacgggtccagatgaggatgaggctgaggctggatggggtgactgacagtctggatcattgaaactgattgggtggttggtcagaaacgggtccagatgaggatgaggctggatggggtgactgacagtctggatcattgaaactgattgggtcgtcagaaactggtccagatgaggctgggtggggtgactgacagtttggatcattgaaactgattgggtggtcagaaactggtccagatgaggatgtggctggatggggtgactgacagtctggatcattgaaactgattgggtggtcagaaactggtccagatgaggatgtggctggatggggtgactgacagtctggatcattgaaactgattgggtggtgagaaatgggtccagatgaggatgaggctggatggggtgactgacagtctggatcattgaaactgattgggtggtgagaaatgggtccagatgaggatgaggctggatggggtgactgacagtctggatcattgaaactggtccactatgacgcagcaggggcagtttggcagagcatcctcttcccttgtccttgtgaaagaacacaggaaacatttgggttttacagcttttcacaccctactatcaggcatcagaatcaaaattagttactaaattgggtgaatttttggaaacctgcatttctatgcatctgctattccagaaaaaaatgggaatgtattacaggagagttacctcacagtgtcttatgttgtggaacctgaaacataaccacgtgttttcttatatgatcatttgtgttgatactgcttttatttgagtttatgaacagaaatagaaagtatggtgcttgggttttgccctttcttactcctgaaagttaaatcagaagacactgatttcattttgtgaaatttagctcagagactattgatcttttgtttcattaatatgaacaactattagtaaaaaatagctttaacagcatttctgctgatatctagtaatctattcttttaatgtgaaaataagataaaatgtcctggagctaattctagcttaaatttgccagtatttctgtatgtcattaagtttttttcctctaaggttggtaatagaattttgttaatctttgcatacctgatggcatctatgtcaatgctgattgggtaattataaattctgtgctaatttaaaacttaatttgcctcttaaggtgattgtcctctgagtaatgattgtagttaaatgaagtatagcttgcaactatactatcacatgggtcgttaagtaaaaataaataaaccaaatttgtctgagacaggctaagatcaatcttctcatcaaaccaatttttctctaagagcaatttcactttcagttttagggtggacattcttgaatgcctcaaattaaacgttatctatttaatcttcctggaatagtctgtgaccaaaaaggagggtgtgatatatttaggtgtaaatatatcacatatatggtgtgatatatttgggatttatatattcagctcattctctgtgaagaagtcttcctgactaaaattggtttcaagataaactaatttctgttagtatttctactctgcctaccatgtatgcctttttgttagaaactaataaatgtatcagtcactagcaggtactggtcctttttcctctcatttttgtggaaaggatatgcaaacactgaatttctcagggagtactaaggctgtgcagaggctgagaatctgaaaaataaaatactaaaaataaaaa

SEQ ID NO: 177321 - DNA, 2202 bp, Homo sapiens
  Payload ID: 14793
  Gene Symbol: RNF168
  Gene Name: ring finger protein 168, E3 ubiquitin protein ligase
  ENST ID: ENST00000437070
  CDS Start-End: 505-855
ggcgcccgaaaggtgaacacgggagtcgcgcgtctcccccgcagcagcggtaaagcggaagttatgctgcagccggagcccgggcttcctcccggagccgcgtcccggggcccggctgccccgagctgagcggagcatcctttccgggtgaggggaggagaggacttggcgcgttcccctcgctgccccgggagccgcagccgcggtgttcatgccgcggagcagccaggctcctccgacgaaaacctgcatttatttgctggcgggacgtttgccttgaaaatggacaaagacgccgccctccggggtattcctgtttgcctgaccctgagagcgcctttttgcttcaagacgtgttggatgctcctgttctccgaattctgatacgcttctgggcataatactgaaacacaaaactgcttttgctctctctgtggttggccgaaaataggattctttttcgtgcaggtgtcgttgtttagtcggctttactaacatattgaaatggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtgggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattaacaatttctgtgagggaagtatctcggcttctcccttgaattccagaaaatctgatccagttacacccaagtctgaaaagaaaagtaagaacaaacaaagaaacactggagatattcagaagtatttgacaccgaaatctcagtttgggtcagcctcacactctgaagctgtacaagaagtcaggaaagactccgtatctaaggacattgacagtagtgataggaaaagcccaacagggcaagacacagaaatagaagatatgccgacactttctccacagatatcccttggagttggagaacaaggtgcagattcttcaatagagtcccctatgccatggttatgtgcctgtggtgccgaatggtaccatgaaggaaacgtcaaaacaagaccaagcaatcatgggaaagagttatgtgtcttaagtcacgagcgacctaaaaccagagttccctactcgaaagaaactgcagttatgccttgtggcagaacagaaagtgggtgcgcccccacatcaggggtgacacagacaaatggaaacaacacaggtgagacagaaaatgaagagtcgtgcctactgatcagtaaggagatttccaaaagaaaaaaccaagaatcttcctttgaagcagtcaaggatccatgcttttctgcaaaaagaagaaaagtgtcccccgaatcttccccagatcaagaggaaacagaaataaactttacccaaaaactgatagatttggagcatctactgtttgagagacataaacaagaagaacaggacaggttattggcattacaacttcagaaggaggtggataaagagcaaatggtgccaaaccggcaaaaaggatccccagatgagtatcacttacgcgctacatcctcccctccagacaaagtgctaaatggacagaggaagaatcccaaagatgggaacttcaaaaggcaaactcacacaaagcatccaacaccagagagaggctcaagggacaaaaataggcaagtgtctttaaagatgcagttgaagcagtcagttaatagaagaaagatgccaaattctactagagatcactgtaaggtatccaaaagtgctcactccctacagcctagcatttcacagaaaagtgtttttcagatgtttcagagatgcacaaagtaaggcctggtaaagggagtgctttgtgatctagtaaagctggaatgtgaagctctttccta

SEQ ID NO: 177322 - DNA, 7823 bp, Homo sapiens
  Payload ID: 14794
  Gene Symbol: RNF169
  Gene Name: ring finger protein 169
  Uniprot ID: Q8NCN4
  ENST ID: ENST00000299563
  CDS Start-End: 14-2140
aacgggaaacaagatggcggctgcaggtccgagtactcgggcctcttccgcggcggcagcagccgctctgagtcggcggggccggcggggccgctgtgacgagacggcggcagctaagactggggccccaggcccggcttctggaccttcgctgttggtgttgtcgccgccgttgctgcagccgccgctgccgccgcggccggaggaatcgggctgcgccgggtgcctggagccccccggagaagcagcggccctgccgtgcggccactcgctttgccgaggctgcgcccaacgcgccgccgacgcggcgggcccgggttgccctcgctgccgcgcccgcggcccaggctgggcccgccgtcgggcccgcgacgacggccaggccgactcagaggtgctgggcgagtgcgcccgccgcagccaacccgagcgctgccgcccgcgccgggacgggggcgcggctgccgcggggcccaggccagagcaggagccgcgtgccgcgcctgcggagccagactttatattcagagcaccaatcaaattaagcaagcctggggaacttcgtgaggaatatgaaagcttgagaaagctgagagaagaaaagttacaagaggaaaaaccctctgaagatcaaatccacaagctgttaccagaggatacagaaacagggaaaaggaaaatggatgaacagaaaaaaagagatgaaccattagtactgaaaacaaatctggaacgttgtcctgcacgtctctcagattcagagaatgaagaaccttctcgaggccagatgacacagacacatcgctcggcatttgtttccaagaacaactcctactccttagctttcctggcagggaagctaaactccaaggtggaaaggagtcagagctgtagtgacacagcccaggaaagagcgaagagcagagtcagagcagttccaggcaacaaagccaaggtcacaactatgactccagcctccaaccccatcattggtgtcctcttgtcaactcaaaacaaccgctgcgtctcggcccctgacttaaccatcgaaaagcgtctacccttcagctccctttcatccttggcttccctgcataagccagagcgttctgtcagccctgagagcaatgacagcatctccgaagaactaaaccatttcaagcccattgtctgctcaccatgtactcctcccaagagactccctgatggccgtgtgctaagtcctctcatcatcaaatcaactccacgcaacctaaacagaagcctgcagaagcagacttcttatgaggccagtccacggatcctcaaaaagtgggaacagatctttcaggagcggcagatcaaaaagaccctttcaaaagccactcttacctctctggctcctgaaatgggggaagagttactaggctctgaaggtatccattctagcaaggagaagccacttgtggctgtaaatacaagattatctggtgggcaggtcctctctgagtatactggacccacctctgctgatcttgatcatttcccctctgttagccaaacaaaagcagaacaggacagtgataataaaagtagcactgagatcccactggaaacctgctgttcctcagaactcaaagggggaggcagtgggacttctttggagagggagcagtttgaggggttagggtcaactccagatgccaagttagacaaaacctgtataagcagagccatgaaaatcaccacagttaattcagtgctaccccaaaacagtgttttgggtggagtcctcaaaacaaagcaacaattgaagacattaaatcattttgatctgactaatggtgttctagttgagagcctaagtgaagagccacttccttctttgcgtcgaggccggaaaagacactgcaagaccaagcacttagaacaaaatggctcccttaaaaaactgcgacaaaccagtggggaggtgggtctggccccaacagacccagtcctgcgagagatggagcagaagcttcagcaagaggaagaagaccgacagttggctctgcagttgcagcgcatgttcgacaatgagaggcggactgtgagccggcgaaaaggaagtgtggatcagtatctcctacggtccagcaacatggccggggccaagtagcacctaatgaagtgttacctatttttaaaaggtcttaggccttgatcatttatcctgaagagctgagtgttctcactttggttttattttaatggcaaaacactgtctaatatggttctgagaggttccagggcctttgtagtcaatatccaagggaaaagcatctccgtttctctgtgacccaggccagaagcctgagtgacccatccctaagggcttctgggccaaacctggcagcacccactgggaatgagatttggaacggcctcaggagcataatggccacagttagtaatggtaaagaggggataccttcttaaactgatagacttcctgacttctttcagcagggtattgttttaaatcagccttgcagataaaaattaattccatctttttcagacaagtgaacaatttagttccttggcagatccaaaatgatagatggttatgttacgctttctgctgtcccttgccaaaaataagtaaatatatcagttaagattatgcctttacaaaagttaatttacattctctgtttaaaaaataatatttggtgaatgctatatagttgacagagcacatttacagaccttattaatttagtctttccaagagacctctcatgtaactggcattagccccatttttagatgatgaaactgcagtgcagatgttctggttctctcaactaccaagtggcataacccatggattttctaaaggtttcccaaatagatcacaacctaagggtgtgccaggggagcctaggggaagctaggctgggcattgaacactgatagtgcagaatccacatgcaaacaagatcgacagggtggataaacatatatgtgcattatccccatcccccacagtttagagccttctgcttttctgggggtttcagcctatgagacaaactataatcaggcttcattattacttttcaaatggccaagggttatctgcaatgttgatctaaaatcctaaaaaatcaccctgaagtcaggcaaggaacaatacttaaactccatactatggaaacaaggtatctagctggatgcagctggtaaattcagtcccatggacctttgggggtttattttccttagcagctgacaccatgtgtcttttgcatccctggtggtgcttggtgcttctgcccatctgggctcattgagaatagggatgaagatatgattttagggaatttctgatgggctggcatgccccatgtagtatgagttactatataaagtcatgtgactggcattttaacagaccttccagagcttatatatcccaatatatgttgtttcctttgagtagccccagcaggatactgcttagtttttccagtgccattggtgaaagcatttctggaactgtcttcaaagactagaaacactgactcccaaaatgctagaactggaagggaccttaatggttatctattccagcctcctcctaaggtcctcctcagcttctagacctagaagccaaagtccagaacagtgacccattgatcaaggcagatagtataactccttttaagtgttctcagatttgccttttctcagggcaaatcttcagtgttttgtggttatttgtggttgagagagagagagaatgtaatgtctgagactagccagcagctatttgaagcctctgggaaagaaggtggcttatcaagtgggtttgtagtaatgagtgctgctgtaaagcagagccattttcttgtgcagctcatagttcccaaacagttcccaaacagaaattccagagatgtcttaaacattgtggtcatcattgagataggtggaatctctttggtgactacgttggtggggaacatcactcacctgaatgtatgcattctgtgttctctgtgtgtgtgcacatatgcagatgtatgttttaaaaacatttaccaaactcatgattttgtagtcacaccacttcagttctgggccctaccaacaatttatgtcctccaagagctgctggagggcatgtttgtgcccaaaacagaagagctggctctggtttacagaagacagggagggtgaccttactataaatgcccttagaggaaacttatcagttactgccatttcacgcatttcctttttgatcttagtaaatattattggaaggctagtcttgttggtaggagcaaagacacttatttttccacttgccatctttctctatatctccagtaatttgaaaaacacttttcagttggaattgatttttgtctttggtaaaaagaaatatttttaatagataaaagatatatattttaaatatttccccaaattaatactttcattttaagaattgcatagcagttgtaacaagtgcagaatgaagaacaaattcttgttaagcaaatagtccaaactctaggtccagcttactgccttccccccttgtacctacagtgatgcctaggatggtattgacagttgttttctaaacttcctgctgagcaacagtccttcaaatataggtagagtggtctaggttaaggagggaggagggttgatctttaatcaggttggctttggaggaaggaaaaaccactaaggtattatctgaattttaagatgcttcccatccttaataactaaaacctgaatgcttttctttctgaaaaatctccctctctccttccatgattctgaagttggttaaaagtcgatatgttgatgtgtattatttgggggaacagaaaaggacaaggaaggaaacagaacgatgggaagggtttgtgagctagaataagaggtgcaggatttcacaaaacaaattcctcacaaatcattgaagcccagttcaccatacaaattacccatgtcttactctgttccttgtatatatgcattctgggtttttttattattaaaggggaagttaggggggagggtgaaggtcagtctgaggggaaatccaggaaatgtggtgcccttagaagggggctgtcagctcttttccatagagagggaaagaaactttgagaaaatgttcttgacccattgattgtatctgctggaagaagtcatctgggcctgttgggttggtatcagatcaggggattatgcatccagcccctggcccctttaatctatttgcctctttttaaaaaaggttaagtcttcttgggtgaggcttgccagggaaactcctaagtggcttcacttattttttaaattttaatttaatttttaaatttttgcttggaagcagcactggtaataaatgttttattttttgttcattttccctaaaggaaaaatgtccttaagagattaaagctcttaattgattactgtctggttacaaactggcaaactgactaaaatgggaagctgccaccgtgcctgactcatgtagctgatgaccgaaggctcatcctttcttttctatttgacagacatttactgagcttcagacttgagccaaccctgagctggactgtggagataaagcagttcctgctcttgaggagctcaatgtctaatggaatgcatttgaatgtatgtgtggctggagagttcatttatggtcttaggaaagccatttctggtcccatttagaaaactgaccagcacccagcaagctgcattctacattttagagaccccattggtatttgtgaatttgattgcaccaccgcttttcctttactaagtaatgttatggaaggagaatgaattttctcctctagtgattacaggacattaacatctcttcagaagctgcttttagcttaagccccaagaagtgaggtgggttgtggatcactgacatggtcaggggaggcccacacctcaattcagtaaccacctaatctctcccccaacctgatctctcatcagagctggcagcaacttgggattcctttcctttttcctgcctaacttttcattgaaatgtctagtaggagagtgagaaaagagaacaaaggctgggtcacagtcatagaatgttacagctggaatgggcatggaaatcatccaagttaaacttcttctctgccccccgcccccacttttttttttttttttttttaaccaaacgaacttgtgatccagtgccctattttatagtgtggttttccagggtctgaataaataatcattaaagtttgacacacgcagacacacgcaccaatgatggggatacccccaaatgatttaggaggttattttattttaatagttttttcttcctgatttttttcagttagttagagttaaatgtacctatagcccctgaatacatgctcaggtagagaaagtctccatagtataagtaagtaatatgaatgtggaatcttggaaagtgatatattttgattggaataattttaattaaatttaatgattttaattaagaattaaaagccagctagccaaattttctttaaaaattggaaactcattatggtcttaaattgtcctcaggcagccttttcctcatcaacccatagagtggtcttttgaactggtatctaaacatacctggttatgaattctcaaaagagaaagcaggtctggggcggggtggtcaggagacagattctagggaaagtgctgaagagattttcttctgaagatgatctaggaaatgcatctttatacatgattgttagctgctgtagctttctgaagaagattgtagaaaagagactaagatatatgcaagggtcaccagtttagagatcagtcaaattggaaaaagtgccaagactggatgtgcagattgttctatgtattatcagtatttttttcctcttaagaaaaaaatttactctctctcctttgtgagtaaatgcctccttaatgccttttaagtaaggtggcaacttttaactgtcatcttgtgagaggcaacctcaaactctaagcagactccctctctccctttctggtgtcttaaatcaagaactagtttgaagccaaggcaaagcaaggtttgttcatcttcctttcctgtcatttaaggtaaaacaggcaatgaactcgctcttcaaataccatagttcaagagtagctgttggccctggttccagattaatatagcagcaggcagattgccccttcttggggccaccaccctccaaagctgtgccaccaatgagagcattgggttcaagtttgcatcaaacatggtattaccaacgctgagcctccagcagagcacttaaaagtcctagtgagagaatagatactatgcaagggaaaaaaatttaaatgccaacgaatagtttttttttttttgaacctgatacactgtttgtttactctcaactctttgtacaaatattattgtcctaagggccttttcccctcctgcctagaaaataggttgtgtattggttttattcaacctgctgtctgctttaggattggagaaggtacctggatccttgtggactgccactgctggctgcctcctctccaactcatcagaagagcattttgacaaagacagaggacttggaccagggcatgccctgttggggatgtttctgtcagcaaggacatggcatggaatcaagtgggctgatgtgttgttatttaaacagtaccaaagtgcattcttcaatgtatgtttgcctgcttgaagcaaggcccaagttgagaatacagtaaaggaaactcatgaaagtgga

SEQ ID NO: 177323 - DNA, 340 bp, Homo sapiens
  Payload ID: 14794
  Gene Symbol: RNF169
  Gene Name: ring finger protein 169
  ENST ID: ENST00000527301
  CDS Start-End: 1-239
acttagaacaaaatggctcccttaaaaaactgcgacaaaccagtggggaggtgggtctggccccaacagacccagtcctgcgagagatggagcagaagcttcagcaagaggaagaagaccgacagttggctctgcagttgcagcgcatgttcgacaatgagaggcggactgtgagccggcgaaaaggaagtgtggatcagtatctcctacggtccagcaacatggccggggccaagtagcacctaatgaagtgttacctatttttaaaaggattggagaaggtacctggatccttgtggactgccactgctggctgcctcctctccaactcatcagaaga

SEQ ID NO: 177324 - DNA, 5119 bp, Homo sapiens
  Payload ID: 14795
  Gene Symbol: RNF17
  Gene Name: ring finger protein 17
  Uniprot ID: Q9BXT8
  ENST ID: ENST00000255324
  CDS Start-End: 53-4924
gagggccgccgggactcgcactcggcggttgttccagaagaaagagacagcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaagtttaagtcacaatcactaagaagtcactttgaaaaaaatactactttacactatcatccacctattttgcctaaagaaatgacagatgtttcagtaacggtttgtcatataaatagtcctggagatttctatcttcagttgatagagggcctggatattttatttctattaaagacaatcgaggaattctataaaagtgaagatggagaaaatctggaaatcctctgtccagttcaagatcaagcctgtgtagctaaatttgaagatggaatttggtaccgagcaaaagttatcggattgcctggacatcaggaagttgaagttaaatatgtggactttggtaatactgcaaaaataacaatcaaagacgtgcgtaaaataaaggatgagtttctgaatgccccagagaaggcaattaaatgtaagttggcctatattgaaccatataaaaggacaatgcagtggtccaaagaagctaaagaaaaatttgaagaaaaggctcaagataaatttatgacatgttcagttatcaaaattctggaagataatgtgctcttagttgagcttttcgattctcttggtgctcctgaaatgactactactagtattaatgaccagctagttaaagagggcctagcatcttatgaaataggatacatcctcaaagataattctcaaaagcatattgaagtttgggatccttctccagaagaaattatttcaaatgaagtacacaacttaaatcctgtgtctgcaaaatctctacctaatgagaattttcagtcactttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacaatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagatgcaatagaagttcttcaacaactgctttcaaagagacaggtggacattcacattatggagttacctaaaaatccatgggagaaattgtctattcacctctattttgatggaatgtcactttcttattttatggcatactataaatactgtacttctgaacatactgaggagatgttgaaagaaaaaccaagatcagatcatgataaaaagtatgaagaggaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacagactgtgccaaattccttctcatcttatgcggtatccagctcgagccataaaggttctcttggcagggtttaaacctcccttaagggatctaggggagacaagaataccatattgtcccaaatggagcatggaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttccaaa

SEQ ID NO: 177325 - DNA, 2134 bp, Homo sapiens
  Payload ID: 14795
  Gene Symbol: RNF17
  Gene Name: ring finger protein 17
  Uniprot ID: Q9BXT8
  ENST ID: ENST00000255325
  CDS Start-End: 4-1965
gcgatggcggcagaggcttcgaagactgggccttctaggtcttcctaccagcgaatggggaggaagagtcagccctggggtgccgctgaaatccagtgcaccaggtgtggaaggagggtatccagatcatccggtcaccattgtgaacttcaatgtggacatgctttttgtgaactatgcttgttaatgactgaagaatgcaccacaattatatgccctgattgtgaggttgctacagctgtaaatactagacaacgctactacccaatggctggatatattaaggaagactccataatggaaaaactgcagcctaagacgataaagaattgttctcaggactttaagaagactgctgatcagctaactactggtttagaacgttcagcctccacagacaagactcttttgaactcatcagctgtaatgttggacactaatactgcagaagaaattgatgaagcattgaatacagcacaccatagtttcgaacagttaagcattgctggaaaagcacttgaacacatgcagaagcaaacgatagaggaaagagaaagagttatagaagttgtggagaaacagtttgaccaacttttggctttttttgattccaggaaaaagaacctgtgtgaagaatttgcaagaactactgatgattatctatcaaatttaataaaggctaaaagctacattgaagagaaaaaaaataatttgaatgcagctatgaacatagcaagagcattacaattatcgccttctctaagaacatactgtgacctgaatcagattatccggactttgcagttaacttcagatagtgaattagcacaagttagttctccacaactaaggaaccctcccaggttgagtgtgaattgcagtgagatcatctgtatgttcaacaatatgggaaagattgaatttagggactcaacaaaatgttatccccaagaaaatgaaattagacagaatgttcaaaagaaatataataacaaaaaggaactttcttgttacgatacatacccaccgctagaaaagaaaaaggttgacatgtctgtcctaaccagtgaagcaccaccacctcctttgcaacctgagacaaatgatgtacatttagaagcaaaaaacttccagccacagaaagacgttgcaacagcatcccctaaaaccattgctgtgttacctcagatgggatctagccctgatgtgataattgaagaaattattgaagacaacgtggaaagttctgcagagctagtttttgtaagccatgtaatagatccttgccatttctacattcggaagtattcacaaataaaagacgccaaagtactggagaagaaggtgaatgaattttgcaataggagttcacaccttgatccttcagacattttggaactaggtgcaagaatatttgtcagcagtattaaaaatggaatgtggtgtcgaggaactatcacagaattaattccaatagagggtagaaataccagaaaaccttgtagtccaaccagattatttgtccatgaagttgcactaatacaaatattcatggtagattttggaaattctgaagtcctgattgtcactggagttgttgatacccatgtgagaccagaacactctgctaagcaacatattgcactaaatgatttatgtctggttctaaggaaatctgaaccatatactgaagggctgctaaaagacatccagccattagcacaaccatgctcattgaaagacattgttccacagaattcaaatgaaggctgggaagaggaagctaaagtggaatttttgaaaatggtaaataacaaggctgtttcaatgaaagtttttagagaagaagatggtgtgcttattgtagatctgcaaaaaccaccaccgaataaaataagcagtgatatgcctgtgtctcttagagatgcgctagtttttatggaactagcaaaagatctgatctaataaagttggttgagacactttctcattttttcaatgtttctgtattggaagaagaacttaaagcttcctaatctattttgttggcgtcattcctctgctgaatttttaaatgttcactctggcttacctgttaatggaagaatttgcataatatctacttagaaaggta

SEQ ID NO: 177326 - DNA, 2203 bp, Homo sapiens
  Payload ID: 14795
  Gene Symbol: RNF17
  Gene Name: ring finger protein 17
  ENST ID: ENST00000339524
  CDS Start-End: 107-2008
ttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacaatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagatgcaatagaagttcttcaacaactgctttcaaagagacaggtggacattcacattatgaaaccaagatcagatcatgataaaaagtatgaagaggaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacagactgtgccaaattccttctcatcttatgcggtatccagctcgagccataaaggttctcttggcagggtttaaacctcccttaagggatctaggggagacaagaataccatattgtcccaaatggagcatggaggcactgtgggctatgatagactgtcttcaaggaaaacaactctatgctgtgtccatggctccagcaccagaacagatagtgacattatatgacgatgaacagcatccagttcatatgccgttggtagaaatggggcttgcagataaagatgaataagtgcctaagtgtatacagtgagagcatctatagaagcctagaagaattctgttatgtttagactatgtcttatctttagactatttcaggcttaattttcctaacttgttcagcactagtgctttacctctcatttttaattgaactgttaggaattgtgtggggaaaaaaagtaaataaatgttcgcttccaaa

SEQ ID NO: 177327 - DNA, 2826 bp, Homo sapiens
  Payload ID: 14795
  Gene Symbol: RNF17
  Gene Name: ring finger protein 17
  ENST ID: ENST00000418120
  CDS Start-End: 260-2826
gctgacacagaccacagatatcaatgtaacacaaaaaatagaagcagctttgaatctaagtacgacatgaaagcctagctctaaagttttgagacttgatatcttatttaacctggtttgataattgaagacaataccaagaaatgttagaagaaagaaattggaagatgagcgcttttggtttaagtcacaatcactaagaagtcactttgaaaaaaatactactttacactatcatccacctattttgcctaaagaaatgacagatgtttcagtaacggtttgtcatataaatagtcctggagatttctatcttcagttgatagagggcctggatattttatttctattaaagacaatcgaggaattctataaaagtgaagatggagaaaatctggaaatcctctgtccagttcaagatcaagcctgtgtagctaaatttgaagatggaatttggtaccgagcaaaagttatcggattgcctggacatcaggaagttgaagttaaatatgtggactttggtaatactgcaaaaataacaatcaaagacgtgcgtaaaataaaggatgagtttctgaatgccccagagaaggcaattaaatgtaagttggcctatattgaaccatataaaaggacaatgcagtggtccaaagaagctaaagaaaaatttgaagaaaaggctcaagataaatttatgacatgttcagttatcaaaattctggaagataatgtgctcttagttgagcttttcgattctcttggtgctcctgaaatgactactactagtattaatgaccagctagttaaagagggcctagcatcttatgaaataggatacatcctcaaagataattctcaaaagcatattgaagtttgggatccttctccagaagaaattatttcaaatgaagtacacaacttaaatcctgtgtctgcaaaatctctacctaatgagaattttcagtcactttataataaggaattgcctgtgcatatctgtaatgtaatatctcctgagaagatttatgttcagtggttgttaactgaaaacttacttaatagtttagaagaaaagatgatagctgcttatgaaaactcaaaatgggaacctgttaaatgggaaaatgatatgcactgtgctgttaagatccaagataaaaatcagtggcgaagaggccagatcatcagaatggttacagacacattggtagaggtcttgctgtatgatgtgggtgttgaactagtagtgaatgttgactgtttaagaaaacttgaagaaaatctaaagacaatgggaagactctctttggaatgttctctggttgacataagaccagctggtgggagtgacaagtggacagcaacagcttgtgactgtctttcattgtacctgactggagctgtagcaactataatcttacaggtggatagtgaggaaaacaacacaacatggccattacctgtgaaaattttctgcagagatgaaaaaggagagcgtgttgatgtttctaaatatttgattaaaaagggtttggctttgagagaaaggagaattaataacttagataacagccattcattatctgagaagtctctggaagtccccctggaacaggaagattcagtagttactaactgtattaaaactaactttgaccctgacaagaaaactgctgacataatcagtgaacagaaagtgtctgaatttcaggagaaaattctagaaccaagaaccactagagggtataagccaccagctattcctaacatgaacgtatttgaggcaacagtcagctgtgttggtgatgatggaactatatttgtagtacctaaactatcagaatttgagctaataaaaatgacaaatgaaattcaaagtaatttaaaatgccttggtcttttggagccttatttctggaaaaaaggagaagcatgtgcagtaagaggatccgatactctgtggtatcgtggcaaggtgatggaggttgtaggtggcgctgtcagagtacaatatttagatcatggattcactgaaaagattccgcagtgccatctttaccctattttgctgtatcctgatataccccagttttgtattccttgtcagctccataataccacacctgttgggaatgtctggcaaccagatgcaatagaagttcttcaacaactgctttcaaagagacaggtggacattcacattatggagttacctaaaaatccatgggagaaattgtctattcacctctattttgatggaatgtcactttcttattttatggcatactataaatactgtacttctgaacatactgaggagatgttgaaagaaaaaccaagatcagatcatgataaaaagtatgaagaggaacaatgggaaataaggtttgaggaattgctttcggctgaaacagacactcctcttttaccaccatatttgtcttcatctctgccttccccaggagaactctatgctgttcaagttaagcacgttgtctcacctaatgaagtgtatatttgccttgattctatagaaacttctaaccagtctaaccagcatagtgacacagatgatagtggagtcagcggggaatcagaatccgagagccttgatgaagcactgcagagggttaataagaaggtagaggcgcttcctcctctgacggattttagaacagaaatgccttgccttgcagaatatgatgatggcttatggtatagagcgaagattgttgccattaaagaatttaatcctttatctatcttagtacaatttgttgattatggatcaactgcaaagctgacattaaacaggttaaaaataaa

SEQ ID NO: 177328 - DNA, 2023 bp, Homo sapiens
  Payload ID: 14796
  Gene Symbol: RNF170
  Gene Name: ring finger protein 170
  Uniprot ID: Q96K19
  ENST ID: ENST00000240159
  CDS Start-End: 410-760
gtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagaggtacgtccggcgcgcggcggccacgcccaccctatcggggcccgcggagccgcggacggcggggtctggccttcttggggtagctctggccgccgaggctctgcggggcggcgggagtcgccgcctccttccccccgggcccctccctcgtctggaagccccagaatcgccccgcggctgtccggagtcgccggcgacggtggaggggccgacgcggagagcggctctagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctc

SEQ ID NO: 177329 - DNA, 1265 bp, Homo sapiens
  Payload ID: 14796
  Gene Symbol: RNF170
  Gene Name: ring finger protein 170
  Uniprot ID: Q96K19
  ENST ID: ENST00000319073
  CDS Start-End: 113-463
ggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatact

SEQ ID NO: 177330 - DNA, 1866 bp, Homo sapiens
  Payload ID: 14796
  Gene Symbol: RNF170
  Gene Name: ring finger protein 170
  Uniprot ID: Q96K19
  ENST ID: ENST00000319104
  CDS Start-End: 110-712
gacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacgggttcatcagagaagagcagccgtgcaagtgagcagacccatcaagaggctgttgcatgcctggacacacagaactctcctgcctgtacagtcggatgcaggtcagggcctcagcatataccccatgaccgaatgctcccttcagcctcaccacgtttatgcttcacgttactagactgtgtttccatcctttggttctcaggttaaatgttccctcctcactcagactacccaaaagtaggcagtgcaaaagtagtgcaaaagtaggcagtgaccctcccctccccttaccccagggcactctgaggcattcagacatctcagcacagcatcatcatattgacatttccattgtctgtctgcttctcactagaacacaagctctatgaaaacagagacaatgttagttttgtccacccagatattcacagatgtaccattatgcctgccaccacagtagtgctcaacacattaaagattaataaataaagcaagggaaagacaggaaagggcagaagacaaggaaagatcacttcttactcagtcatggctgccgcccaggtctaagccaccctcacttctcacctaaaggatcacagcgaccttccaggcagtctcccaggcaccaagtgcctggctccctacatgcaacgcagcccgatgatcatctcaagtgtgactctgctggaaagcctgctctccctttcccacagagtaaaggtaaagtcctcacgccagcctgcaaggccccatgtgaccttggttgctcatttcctctctaacctcatctcacatttgtccccacagctcactctgctccagccatccagccctccttgctgtcctttgagcaggctgaagacgcccagcctcaggagctctgccctggccagtccctctgactgctaggctcctccgccgggcatcctcacagccaactctcaccaactccagatcttcgcacaatagccatttcctctgttaggcctgtcctgtccaccataaggaaacttgcaactccctcagcccacagagcacctctcaccggctaacatactctgtggtcacgtgtttgctatctgcctccctaatgtctttgagaacattagctccctgagggcagaaatctccttcactgacatatcccaagcccccagaactatgcgtgcagcatagtcagtaactatttgttgaatcaatgaatgagaaaacaatatcagggaactctaagttgaaatacactttctcagttcacaatgttatccattctgacctttatcagacacaggcacagaggacctcagagatattcccagcagtctcaatatccatggtaatgctaataaactactattctggca

SEQ ID NO: 177331 - DNA, 3880 bp, Homo sapiens
  Payload ID: 14796
  Gene Symbol: RNF170
  Gene Name: ring finger protein 170
  Uniprot ID: Q96K19
  ENST ID: ENST00000527424
  CDS Start-End: 246-1022
ttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaagatgaaaaacatttatctccagtcagcacacttgatgttcacagttagacatttaaacaagagctcatcctttcgtagtagatataaaagtaatttgtaaagggaagattgttttaggaacctgggcgatgctgcaaacacagagtagcctgatgcatttctgaggaaggtgaatcttcgtgtctttgagcatcaagccaataggaaggtactgggaacggtatttacatttgacaaaagaaattactggttagctatagcaacagattggacaaattttgttagttttctgttgtcagaaatttttataatactgtctcaggatggcagcacacagctcagattcatgtcttgagccaaacaagtgaatgtatctgagaagactcagtaccacatggtactgggagatcttactcacttcagctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagtcatacaacaaataactgatcaaagtggcattacaccaaaatttcttagtaggactcctgcatagaatgtttagatagacgtgaaagttgttaagaggaacagcaagagagaaactggttctttggaagtctttcgtgctacattatacctccatcagagtaagacagcttaggcactcctaagaggaaaggtctgtggagatgacatgaatccgaattctacacttccaaatcaaataggtaaaagggtggcatacatcacagaaaaacatttcagctgcagtcaccaacttgaaaagcgagtgagtaggagtttgtcacactgccatgtaccagactggaaatgcatttcctaccaattacacatttggtgtgggggaatggtgatgtcattttttgacaggattttattttgtgtgcatgcattctgctccaagtgtcacaattctggttacaataattataatatttggagttactactaagactttcctgaaagaggtgtattgtaccaaattttgtaacataaaaaaatactaaatgatcttaaagcttcctaaattgtgaaaagggtatgtgctaacatctcagaactttagacctgcttgttgtcatctttaccgatctctgatgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgtggggaacaagacggggaaaacaactgttctaactgcccactagaacagtggtttcaactactacaattctcagtgtttgagaggtacaagggaagaaaggactatgtggatcccttgtggctatgcagatacctacctcacagagttgttgtagaagactggtggtttggttcaaaccttgtgattaaagagtttgtcaagcattttattcttttgaataaaagcaacatatctaaaaca

SEQ ID NO: 177332 - DNA, 1338 bp, Homo sapiens
  Payload ID: 14796
  Gene Symbol: RNF170
  Gene Name: ring finger protein 170
  Uniprot ID: Q96K19
  ENST ID: ENST00000526349
  CDS Start-End: 362-886
ggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactat

SEQ ID NO: 177333 - DNA, 580 bp, Homo sapiens
  Payload ID: 14796
  Gene Symbol: RNF170
  Gene Name: ring finger protein 170
  ENST ID: ENST00000531440
  CDS Start-End: 235-580
aaattagaaaggggacgtctagtgggttgcccgggaggggtggcgggagcggtcctggaaataatctgtcctctgtcgccgggaactggcgaggtagttccttcgcggtggagaggtgtcttataagactttgacacttcctgttttgtctgaaaaaaatgtgaattacctgtgatatttggactccagtgtggctgggctatctcccctcatacctatagaattagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggc

SEQ ID NO: 177334 - DNA, 195 bp, Homo sapiens
  Payload ID: 14796
  Gene Symbol: RNF170
  Gene Name: ring finger protein 170
  ENST ID: ENST00000524954
  CDS Start-End: 59-195
ggcaccgtcgcccgcagcgctcgccccacgggccgcgcgtggagggtcccgacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcag

SEQ ID NO: 177335 - DNA, 4116 bp, Homo sapiens
  Payload ID: 14796
  Gene Symbol: RNF170
  Gene Name: ring finger protein 170
  Uniprot ID: Q96K19
  ENST ID: ENST00000534961
  CDS Start-End: 478-1254
agttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagaggtacgtccggcgcgcggcggccacgcccaccctatcggggcccgcggagccgcggacggcggggtctggccttcttggggtagctctggccgccgaggctctgcggggcggcgggagtcgccgcctccttccccccgggcccctccctcgtctggaagccccagaatcgccccgcggctgtccggagtcgccggcgacggtggaggggccgacgcggagagcggctctagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaagatgaaaaacatttatctccagtcagcacacttgatgttcacagttagacatttaaacaagagctcatcctttcgtagtagatataaaagtaatttgtaaagggaagattgttttaggaacctgggcgatgctgcaaacacagagtagcctgatgcatttctgaggaaggtgaatcttcgtgtctttgagcatcaagccaataggaaggtactgggaacggtatttacatttgacaaaagaaattactggttagctatagcaacagattggacaaattttgttagttttctgttgtcagaaatttttataatactgtctcaggatggcagcacacagctcagattcatgtcttgagccaaacaagtgaatgtatctgagaagactcagtaccacatggtactgggagatcttactcacttcagctggcgttgctcattagtgaatgtatgacagcaggatgtgaggggatgcccaggagtcagtgttagcattgtcatctgagatcactgctattaatatcatccattaatttattagtgagcttcactatatgcagactgggagataaggagaaaatctgtcacattctctctagctaatcagatcagctaccaattaatgagattctgaatgaaatatcaatatgtgtttttctaatttggacctaggacagagctgttgcttgtcatagagaaaaacaataatgcttaaacatagcacattataattaaagcaggtttctcacatacttttcattttatcctttggataattttgtgaggaacgcaggacaccaacttccctttcatagatacaatccccatgctattgatgaaagtgtttttgaatgaagtcatacaacaaataactgatcaaagtggcattacaccaaaatttcttagtaggactcctgcatagaatgtttagatagacgtgaaagttgttaagaggaacagcaagagagaaactggttctttggaagtctttcgtgctacattatacctccatcagagtaagacagcttaggcactcctaagaggaaaggtctgtggagatgacatgaatccgaattctacacttccaaatcaaataggtaaaagggtggcatacatcacagaaaaacatttcagctgcagtcaccaacttgaaaagcgagtgagtaggagtttgtcacactgccatgtaccagactggaaatgcatttcctaccaattacacatttggtgtgggggaatggtgatgtcattttttgacaggattttattttgtgtgcatgcattctgctccaagtgtcacaattctggttacaataattataatatttggagttactactaagactttcctgaaagaggtgtattgtaccaaattttgtaacataaaaaaatactaaatgatcttaaagcttcctaaattgtgaaaagggtatgtgctaacatctcagaactttagacctgcttgttgtcatctttaccgatctctgatgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgtggggaacaagacggggaaaacaactgttctaactgcccactagaacagtggtttcaactactacaattctcagtgtttgagaggtacaagggaagaaaggactatgtggatcccttgtggctatgcagatacctacctcacagagttgttgtagaagactggtggtttggttcaaaccttgtgattaaagagtttgtcaagcattttattcttttgaataaaagcaacatatctaaaacatttt

SEQ ID NO: 177336 - DNA, 1604 bp, Homo sapiens
  Payload ID: 14797
  Gene Symbol: RNF175
  Gene Name: ring finger protein 175
  Uniprot ID: Q8N4F7
  ENST ID: ENST00000347063
  CDS Start-End: 374-1360
ccagtcctgccgcccggtaacaaaaccggggttcccgccacacgcacccggtagggctcaagacgctttatcggcgacaatggctggctgaatgggaggcctgaggttctgaaggaaccggggtgctggcgaccgggacctcgaggccgctgctggggaggacgctggccagcgtgcagggggcggaggcggggcgtgccgggaggctcccatctcccgccccgcacaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaacctgcagcaggagaggatgtacaagatgcaccggggccacgattccatgcacgtggaaatgatcttgatcttcctctgcgttctggtcattgcccagatagtgctggttcagtggagacagaggcatggccgatcctacaatctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtctttcatgaattctgcatccgaggttggtgtatcgttgggaaaaagcagacttgcccttactgcaaagagaaagttgatttgaagaggatgatcagtaatccctgggagcgcacacattttctgtatggacaaatcctggattggcttcgttatttggtggcctggcaacctgtggtgataggaatagttcaaggcattatctattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaataaagcatgttttttcatctttcccattacagctgtttcttaactcatgcacatgtcacatttg

SEQ ID NO: 177337 - DNA, 824 bp, Homo sapiens
  Payload ID: 14797
  Gene Symbol: RNF175
  Gene Name: ring finger protein 175
  ENST ID: ENST00000513656
  CDS Start-End: 109-219
ccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaactggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtctttcatgaattctgcatccgaggttggtgtatcgttgggaaaaagcagacttgcccttactgcaaagagaaagttgatttgaagaggatgatc

SEQ ID NO: 177338 - DNA, 3203 bp, Homo sapiens
  Payload ID: 14797
  Gene Symbol: RNF175
  Gene Name: ring finger protein 175
  ENST ID: ENST00000503694
  CDS Start-End: 149-514
acaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaacctgcagcaggagaggatgtacaagatgcaccggggccacgattccatgcacgtggaaatgatcttgatcttcctctgcgttctggtcattgcccagatagtgctggttcagtggagacagaggcatggccgatcctacaatattggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtgtatccttttcaaaggaaattgtttgggcttcatcaagcctccttctttcctccttctcctcctcctcctcctgtccccatctcctccatcttgcttaccttccatgcccaaaccccagtcctttatcctccagcccagtcgagtcttcctgtttgtccctgctgaataatgaactgctaattaaggtgaacctcctcctccagtaatttcctttctaaagaggactgttaatgccacatagacaggaaggcagtatctgagcagggtgctggcaggggaaattggttgaagtcataagtgagcagatagccaacaaagatcagggaaagaaggggtttggaggtgagaaaaagagtgaagtatcaggtgcaggggggaacttaagactatccaagtggagcccaaggtctgaatcttagcagatcaagaaatacaaagagtgctttgcctagaaataatcctaggaacctacctgtggcaacagtagtcttgggggcagccaagggaggaaaccaagccttcttctcagcttcagtctttagaagaagatacagccacaggcagcaagacaccttggattacaaaagcagggaccaaaatttggacatttgttcttggaccatgggctcctccaccaatgggttctatcccaaatagctatccattggctgagggatcttcatatgataggtaccagacagcctgagcctggaaaccagcattctatgtgaactccagtaaccattaaggaaagcctcaatgtgctgaaaaatgctggcatcgagacccctgaacaaatcaacctgtgttgcctgaacatgtatggacactacttttgctatggataccaaagttaggcttaggttggccaatcatcagtattttaattcttcctaaatacaaaaaagggtatcatttatctttattttatagtacagtatcaatttaataatgtcatcgctatgtacccagttagttcaaagctctggcattatgagatggttaaaccatctgtcttttgcctaaagcccacttaatttagtcagtcatacctcggtgtccagtacctatgattcaattctgtttaatctggacagtttccacttattcaatcctgaaagtaaaaccaggaccaaatgcatctcaaaagtaataggagcctttactccaatacataagccttaaaatcttaagggaagaaacacaaagataccccatatggatttctgtagtggttttttcagtgtgatacctttcccaaaaaactcattctttgtagcaattttccaagtctggccctagttttaaatatgatttatttttcaaatgttggaacagagccccttctgccatttgcaaatggaaatgttttctctctccacctttaaaagcccttagggattgttgtacatgtgtgcatatataatctaaaatgtagtcacctttaaatttgcttttcagggagtattattaatggcccattttagcatgagtcatattagtgagaaatgggcaaatatgagtcatattaacaaggatgggttatctgagtcttgctctgcagaagttctgccagtgtgcaagtttttcagcattgagattttgaaaatgaaaaagaacattagagagaatgtggacatttctgtgctgactcaatggcccctgaattctatacctctgtagaagatggggctgtattccagcccttttgaatgaaaggctgtttgagttttggttcaaaatcttcgttataatacaccactttattttaaagcatattgcaaaaatgaccccaattccaagaacataaaataatggaaactcctggttacattgaaatttaatactgaggagttatatacatggccttgacttgctacacctccaagctcctccatttgttagggagggaacttctacatcgttgctgttcacctgggtgtgtagcaggccagtcagaagatcatgtgatcttggcccagaaagtcacattgggagcagcgattgtagaaataaacaaatcagtaggatggatttcattatagttcattttgcccaaatccatagtatcagggaacatggaaatatatattcccaaaaataatcagttttgaaagagtcattcaaatgttcattcaataaatatttcttaggcatggcttaaggtgctgaggacactgaaatgaatgagacatagtcctacaggtaacacatggtctaggagaaacatgtaagtaccaaaagtcctgctacactagagtaagtccctggtgctgtgagaacacatagggttcactcaagtttggggacaaagggtcagactttctggaccaggagacgtatacaaatggatctgtaaatgcctagagtttgagaagttaagtttagtaggtatatattctattaaaaataattggctccttatcagtacttttaaaagtcaag

SEQ ID NO: 177339 - DNA, 512 bp, Homo sapiens
  Payload ID: 14797
  Gene Symbol: RNF175
  Gene Name: ring finger protein 175
  ENST ID: ENST00000507512
  CDS Start-End: 12-218
gtggctcaggcatggccgcggggacggcggcgcggaaggcagcgccggtgctggaggcccccccgcagcaggagcagctctctcatacaaagctttctgcagaagacacatggaagttgagggctttttcagatgacctcattttgctggttccagcctgcagcaggagaggatgtacaagatgcaccggggccacgattccatgcacgtggaaatgatcttgatcttcctctgcgttctggtcattgcccagatagtgctggttcagtggagacagaggcatggccgatcctacaatctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgg

SEQ ID NO: 177340 - DNA, 585 bp, Homo sapiens
  Payload ID: 14797
  Gene Symbol: RNF175
  Gene Name: ring finger protein 175
  ENST ID: ENST00000508248
  CDS Start-End: 136-585
ggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttgccgagatctgctcagactacatggcttccactataggg

SEQ ID NO: 177341 - DNA, 1727 bp, Homo sapiens
  Payload ID: 14798
  Gene Symbol: RNF180
  Gene Name: ring finger protein 180
  Uniprot ID: Q86T96
  ENST ID: ENST00000296615
  CDS Start-End: 111-1361
aaccggcatcgccgccgccggagccgcagcgagtcctcagagcctggctgctggcggccgggagcgccgggacggggcgcgaagccggaggctccgggacgtggatacagatgaaaagaagcaaagaattgataactaaaaatcatagtcaagaggaaacaagtattcttcgttgttggaaatgtagaaaatgtatagcaagctctggttgttttatggagtatcttgagaatcaagtgattaaggataaagatgattcagttgatgctcaaaatatttgtcatgtgtggcacatgaatgtagaagcccttccagaatggataagctgcctaatccaaaaagcccagtggacagttggaaaactgaattgtcctttctgtggggcccgtttagggggctttaattttgtcagcactccaaaatgttcctgtggccagcttgcagctgtacatctctccaagagccggactgattatcagccaacacaggcaggcagactaatgagaccatcagtgaaatacttgtcacatcctagagttcagtcaggttgtgacaaggaagctctgctgacaggtggtggctctgaaaacagaaatcacaggcttttaaacatggcccgaaataataatgaccctggaagattaacagaagcactctgcctggaggtgcgaccaacatattttgagatgaagaacgaaaaactgctgtccaaagcatcagaaccaaaataccagctttttgttccccagcttgtgactggcagatgcgctacaagagcttttcatagaaaatcacatagtttggatctgaacatcagtgagaaactgactttattacccactttatatgaaatacatagtaagactactgcctattccagactaaatgaaacacagcctattgacctttcaggcttgcctttacaatctagtaaaaatagctattcctttcagaatccatccagttttgatcctagtatgctgctgcaaagattttcagtggccccccatgagacccagacacaaagaggaggagaatttcagtgtggtctagaagctgcttcagtgtattctgaccatactaatactaacaatctgactttcctgatggacctgccctcagctggcaggagcatgccggaggcctcagaccaggaagagcacctctcccctctggacttcctgcactcagccaatttttcattgggcagcattaatcagaggcttaataagagagaaaggagcaagttgaagaatctaagaaggaaacaacgaaggcgtgaaagatggctacagaagcagggtaaatactcaggagtgggattgctggatcatatggtaagtatatatttacttatatgagaaattgtcaaattgttttccagaatggctgtaccattttgcattccaagcagcaaagacttccattttctgtgcgtccttgaaagcaagcactggtattctcagtgttttaaaattttagtcattcaaatacatagacagttgtatcacatcatgactttaatttgcttttccttaaggatgctgaacatatgtgcttattttacatttgtatatattctttagttaagtgtcttcaaatcttttgggctggtgtggcagcttatgtctataatcccagcacttttgagaggccaaggcaggaggattgcttgagttcaggagttcaagaccagcctgggcaacatagcaaaaccttatctctac

SEQ ID NO: 177342 - DNA, 4906 bp, Homo sapiens
  Payload ID: 14798
  Gene Symbol: RNF180
  Gene Name: ring finger protein 180
  Uniprot ID: Q86T96
  ENST ID: ENST00000389100
  CDS Start-End: 73-1851
agagcctggctgctggcggccgggagcgccgggacggggcgcgaagccggaggctccgggacgtggatacagatgaaaagaagcaaagaattgataactaaaaatcatagtcaagaggaaacaagtattcttcgttgttggaaatgtagaaaatgtatagcaagctctggttgttttatggagtatcttgagaatcaagtgattaaggataaagatgattcagttgatgctcaaaatatttgtcatgtgtggcacatgaatgtagaagcccttccagaatggataagctgcctaatccaaaaagcccagtggacagttggaaaactgaattgtcctttctgtggggcccgtttagggggctttaattttgtcagcactccaaaatgttcctgtggccagcttgcagctgtacatctctccaagagccggactgattatcagccaacacaggcaggcagactaatgagaccatcagtgaaatacttgtcacatcctagagttcagtcaggttgtgacaaggaagctctgctgacaggtggtggctctgaaaacagaaatcacaggcttttaaacatggcccgaaataataatgaccctggaagattaacagaagcactctgcctggaggtgcgaccaacatattttgagatgaagaacgaaaaactgctgtccaaagcatcagaaccaaaataccagctttttgttccccagcttgtgactggcagatgcgctacaagagcttttcatagaaaatcacatagtttggatctgaacatcagtgagaaactgactttattacccactttatatgaaatacatagtaagactactgcctattccagactaaatgaaacacagcctattgacctttcaggcttgcctttacaatctagtaaaaatagctattcctttcagaatccatccagttttgatcctagtatgctgctgcaaagattttcagtggccccccatgagacccagacacaaagaggaggagaatttcagtgtggtctagaagctgcttcagtgtattctgaccatactaatactaacaatctgactttcctgatggacctgccctcagctggcaggagcatgccggaggcctcagaccaggaagagcacctctcccctctggacttcctgcactcagccaatttttcattgggcagcattaatcagaggcttaataagagagaaaggagcaagttgaagaatctaagaaggaaacaacgaaggcgtgaaagatggctacagaagcagggtaaatactcaggagtgggattgctggatcatatgactttgaataatgagatgagtacagatgaagacaatgaatatgcagaagaaaaggatagctacatctgtgcagtgtgtctggacgtttatttcaacccttatatgtgttacccttgccatcacatcttctgtgagccctgcttacggactctggccaaagacaatccttcaagcactccatgcccattgtgtcggacaattatttctagagtctttttccaaacagaattgaacaatgccacaaaaactttctttactaaagaatatttgaaaataaaacaaagctttcagaaatccaactctgcaaaatggcccctaccaagctgcagaaaagcatttcatctttttggaggtttccgcagacatgcagctccagttacaagaaggcagttcccacacggtgcacacaggatggattacctgcactttgaggatgatagccgtggatggtggtttgacatggatatggtgatcatatatatttattcagtgaactgggtcattggattcattgttttctgctttctttgctattttttctttccgttttaggaatttcataccttactacaattgaccaatcataaatgatgtaaataacaattgcttaaacatttttaaatgtgctttgaagtttttttaatgttgcattatacaaattgttgatgtttatagaaagcctgagaataatgaatttatttattaatgtttttcatgtaacaaactaaactttattcaagagctaacctacccagcacttagcaacaatgcactattaatttcatagttgttcttgggttaggatttggggctctgattttataatatcactttaatacttattttgattgtaaaaaactgaagttttctctccacttaaaaatagtaaaaatacaaaaagaaatgataatctaggtagatattatctttactgataaaatatttagtcaatcaccacttattctcaggcaaattatatgtattaaagataaaccatattctctgggaactaatctagcagggtatattcagttttggtttctaattgtcactacttatatccctttctagtaccaagaaaactgactattctttttgtacagatctaattagtacaacattttaaattattataaacagaatactaaatacaaatcatgagactaatccctaccaataaacactttagctagctataaacactttccagattgaaggattaatcaccagaagacatgaaaaatttaccgacttttagtagtctaaaagagcaatgcatggtccaaaatgtaatttagtgattcatttaagtaggagatggtcaaatatattgtaaatgtgcaataaagagtggcttttaatttttttaatgtctgaataaagtattgttataaataggcttatcgattttagaaagaaaacctgacatttttaattacagtaatcattaatttttttcattattaaaatttaaaaataagagaactgaatcattagaacatggaattggggcaggtaacccaattcaaaaaaggaaaaactggagcagagacttaagcttatttattcagttattctggtggtctttgtgaaacctgggacaaagtttttattatgaattactaatccagtattactacactatgatgtcatatatctggtaattcaataagcaaacttttacataaaataggtgactctctcgtggcactaaaaatactaccactatccaaaaacattgggatcaactgggctttaacagtttcaatctatgaaaagccaaaatttaagctaattgctactaactgtatttcaataaaagcacttgactgttggtatgtgatgttctaagaaaactagaagaatggtactgatttctattctaatgctgttcttattattgtgttttaaattatatctattacagaaaatagtatacactagacatcaaatccagaaatcagaacactaagtacaatttagaaacacagataaatttatacttataaatggatatttataattactaattgctcaaagtaaacataagggaaaatatcagctctcttaaaatatatagcaagattgaaaacacacatatgaggagttgcattattttaagaactttaaattgcagccatttcctaggcaacttctggtttatacactctagaaaatatatcttgattcattcctaaatcacaataaaggttttaattatgtataaactaaataagtattattatagatacagatctctcataggaacaaagttgattcccaatatatatttgttaggtcagtgatacatatcagtttatagatctcagtctactaaatatttatgatacccttaaataaacatgaacctttaaatgaagaaagcataatctggaaaagcattcaaaatggattgagtatatttatcttgactaataacttgatctgaaaattatagaatattaaaagaagtaaattcataaaattataaattactaatctttaaaatattcttaaattttgtaaaagtggagataaaaactgctaaatattaagaagtatagcatttcctagatctaccagcttataagaagccagataaaatctcagatggaaagaaaccagtttcttctggtatgtagcacacagtagccattcaaaataaaatacatggatgagctttagagtaaaacaaaaaattataatgctcttcctaagcatctctcacagtaaaaactcactgtccaataaagagccaaagaaaggaaaagaagaaaaatgttaaagttaatgaagcatagtacttgtcccaagtaatattatttaataagcttaattttatgagttatcattatcaataatttctatttctaccaagcttaattatggtaaaggttaattttaaacatgttcacacattcttttttaaaaaaatgccctaattgaggtatatttctgaatagtttcagcaggttattttttaattttaaaaaagcaaattcacaaacctagacccatttattttatactcagcagaagacagggaaatttaaattagacaaagttgaaaaagaatcagaatttatattttacaaagcttctaccactctgaatcaacaaaatcaggaatggaaaaaaaaatttctgtatctgctgaattattaatgccactatagtattatatgctaaatatgaaagcagtgctgccatcagtttcacttctgccttggaatcttgctcctaagttagctctgtggcataacaaaattccagttaataaaattttcatttaaatgtcttttgtatggctaaatgaatatacagattcttaaacatctaatttttatatggatttctcaaagaatgccttacagaagagcattctctgattaaatgcaattacagttggagtctttgattcttcacagaattctgtagttgaagccagaaaacactgtcatttaggaaagtgttcctaaaggtttgaatgctttaacatgctcaactcttacttcttgaagtgtttgattgtcagtaaattttcgaagaacattaaagttctaccaatgtagaagcatgaggaataaaagatggtctggatcaagaa

SEQ ID NO: 177343 - DNA, 421 bp, Homo sapiens
  Payload ID: 14798
  Gene Symbol: RNF180
  Gene Name: ring finger protein 180
  ENST ID: ENST00000504296
  CDS Start-End: 101-421
tcgcacctgaggctctcggagcggcctcggggcgcgcccacctggaggttggaattacacagggtcgaaaaagctgagtcctggaggcgaggcgctgtagatgaaaagaagcaaagaattgataactaaaaatcatagtcaagaggaaacaagtattcttcgttgttggaaatgtagaaaatgtatagcaagctctggttgttttatggagtatcttgagaatcaagtgattaaggataaagatgattcagttgatgctcaaaatatttgtcatgtgtggcacatgaatgtagaagcccttccagaatggataagctgcctaatccaaaaagcccagtggacagttggaaaactgaattgtcctttctgtggggcccgtttagggggctttaattttgtcagcactccaaaatgttcctgt

SEQ ID NO: 177344 - DNA, 569 bp, Homo sapiens
  Payload ID: 14799
  Gene Symbol: RNF181
  Gene Name: ring finger protein 181
  Uniprot ID: Q9P0P0
  ENST ID: ENST00000306368
  CDS Start-End: 31-492
ccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccac

SEQ ID NO: 177345 - DNA, 535 bp, Homo sapiens
  Payload ID: 14799
  Gene Symbol: RNF181
  Gene Name: ring finger protein 181
  ENST ID: ENST00000443647
  CDS Start-End: 9-245
gggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacaga

SEQ ID NO: 177346 - DNA, 327 bp, Homo sapiens
  Payload ID: 14799
  Gene Symbol: RNF181
  Gene Name: ring finger protein 181
  ENST ID: ENST00000414390
  CDS Start-End: 17-327
agaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgttttccaggtcaggtgggggcaagtgtccttcaggagtgggagcttgggaggcagagcctgtagcagctctcctgatcagcactccttcctaaa

SEQ ID NO: 177347 - DNA, 844 bp, Homo sapiens
  Payload ID: 14799
  Gene Symbol: RNF181
  Gene Name: ring finger protein 181
  ENST ID: ENST00000441634
  CDS Start-End: 40-459
gagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggtaggggctgatgcttaagtggaggggtcgtaatgggctccctgagtcctgtccccgctgccatcacttcccacctcagcaggactgggtaggcctcagaatccctggctctggctgtcttcttagtgactttgatttgtggtgagagcctcagcaatgcagacgccagaggcctgaaaacagagccagccccataatagctgcccatcccctcacccataggccttcagttttggcccctgcccagcatgccttctttccttcaggctcgaaaacagcagcagcaacaccgactggagaacctccatggagccatgtacacgtgaggaggttggggctgagtgctggccctctgcgtcttccttattaaccttgaatcctcattaaaggtttctttacccac

SEQ ID NO: 177348 - DNA, 559 bp, Homo sapiens
  Payload ID: 14799
  Gene Symbol: RNF181
  Gene Name: ring finger protein 181
  ENST ID: ENST00000456023
  CDS Start-End: 1-511
gacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccag

SEQ ID NO: 177349 - DNA, 646 bp, Homo sapiens
  Payload ID: 14800
  Gene Symbol: RNF182
  Gene Name: ring finger protein 182
  ENST ID: ENST00000488763
  CDS Start-End: 494-646
gtgcatgctgcggcagttgcaacaggagaaccgagtaccagttgctcaacactttatcactttgcattgctctttctcctcccttaagtgaatttccattttgagggtacagctccacaggagaaaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatc

SEQ ID NO: 177350 - DNA, 557 bp, Homo sapiens
  Payload ID: 14800
  Gene Symbol: RNF182
  Gene Name: ring finger protein 182
  ENST ID: ENST00000471906
  CDS Start-End: 519-557
aacctccctcccctcccaggcgccgccgcagccggagcggctcccgggccctgggccgccgccggccagactgcctgcaagggatggtcatactcctggctgcacttccagagtcttgaagaagaaagcagatgtggatacctaaatatagggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcag

SEQ ID NO: 177351 - DNA, 633 bp, Homo sapiens
  Payload ID: 14800
  Gene Symbol: RNF182
  Gene Name: ring finger protein 182
  ENST ID: ENST00000423553
  CDS Start-End: 386-633
gtctccctccgggcaccacgggggccgccgtcctggcaccaacttgaggggctgtgcggcggagggcggctgcggagcgcccgcgcgggctgcacctgctcagggagctgcccctctgttgttgttgttattttccttcttggcgtgccatcgaggcttttgggggaaaaaaagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccga

SEQ ID NO: 177352 - DNA, 826 bp, Homo sapiens
  Payload ID: 14800
  Gene Symbol: RNF182
  Gene Name: ring finger protein 182
  ENST ID: ENST00000420478
  CDS Start-End: 340-826
agacaaagccgcccgcccgccagcccgctagctcctcgcgcgagctcctcctccacgggaacctccctcccctcccaggcgccgccgcagccggagcggctcccgggccctgggccgccgccggccagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcacca

SEQ ID NO: 177353 - DNA, 3706 bp, Homo sapiens
  Payload ID: 14800
  Gene Symbol: RNF182
  Gene Name: ring finger protein 182
  Uniprot ID: Q8N6D2
  ENST ID: ENST00000488300
  CDS Start-End: 524-1267
gacgcagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaatttagaagtttgatttctctgacttatggttaaaattcagttatgactttgcacctctgttagctttagataacggcaaacatgaacattcagaaacgttggttcagctaatgcctttatcatgcccgtgaagacttcagaactttccaacaaaggggacctaacccatcacacttttaaaaggccttcatagtttttttattttattttattttattttattttattttattttatttatttattttaaagcaggggagaaaaattaggggagatgaaataaaaatatcgtcttta

SEQ ID NO: 177354 - DNA, 3274 bp, Homo sapiens
  Payload ID: 14800
  Gene Symbol: RNF182
  Gene Name: ring finger protein 182
  Uniprot ID: Q8N6D2
  ENST ID: ENST00000537388
  CDS Start-End: 386-1129
gtctccctccgggcaccacgggggccgccgtcctggcaccaacttgaggggctgtgcggcggagggcggctgcggagcgcccgcgcgggctgcacctgctcagggagctgcccctctgttgttgttgttattttccttcttggcgtgccatcgaggcttttgggggaaaaaaagacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaattt

SEQ ID NO: 177355 - DNA, 3495 bp, Homo sapiens
  Payload ID: 14800
  Gene Symbol: RNF182
  Gene Name: ring finger protein 182
  Uniprot ID: Q8N6D2
  ENST ID: ENST00000544682
  CDS Start-End: 607-1350
gacgcagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccagactgcctgcaagggatggtcatactcctggctgcacttccagagtcttgaagaagaaagcagatgtggatacctaaatatagggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaattt

SEQ ID NO: 177356 - DNA, 3382 bp, Homo sapiens
  Payload ID: 14800
  Gene Symbol: RNF182
  Gene Name: ring finger protein 182
  Uniprot ID: Q8N6D2
  ENST ID: ENST00000537663
  CDS Start-End: 494-1237
gtgcatgctgcggcagttgcaacaggagaaccgagtaccagttgctcaacactttatcactttgcattgctctttctcctcccttaagtgaatttccattttgagggtacagctccacaggagaaaggaagaaatacttgtgttggctgcatttccagggatgctaccagagctcaaggctgtcacctggtcttgcccagaagagccgttcttagaggcaggacttgatgaaggctttcctgctgatggaataggtttgctagagctggccttggaattagaacccttcatgtggcctttataaatatgcgtttgagacagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagatggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatggatgttctatgatggcagttggacacaagaggaaagttgctctgagacacaaagtgtgtactcctttcccaccccatacccctggtattggaacaccctagaattgtcttcaggtgttttctctcttaagtcactctctgtggtcggcgatcccattgagatacttgtttcctctgcccattctcccttgccaagaggaaactcggttccattcccttgggtagtttcaactgaataccagttttgccacattactaaggagaatgaaaagcactgaggaatttgcatcacagtcagcttcatggcagaatgtggccatttgtccttgagacacactctttcctccatgtctgttttcctctctcctcagtcttatctgagaagaatggaggagaaggaacttctcatacagcggttattattgatgaaaaccttcatttgagtctttccttataacatcttagttttggtttttttaaaccacattgcccaatcagcctcaccccttgtcctgaaaaggttccatttaaattagttgctataaattcatcaatactttttttccctattatatttttggttctattaggatttacttaactgaatcttataacaattcgaggtgaactgtggcaatgaaaaccagaaacagttaatgagatgcttcagctcacagtttgaagtgctgagaacctaagtattttgctgtacggtactgagctgtaccaaaatatgatggtttaggtttatgtgcaagactttgtgttgtagtctagacaaaggggtgggcaagagacatgcaaagctgaagccctgcttgaaaagacccttcaaggaagtaaaatggcaggggcagagtgcagcttaacatgttgctatccctgttgtttttgagttggttttggaatggattcaagttcttacacaatttattttgaatacaagcataatctaggtgatttgagttaatgaacttcttttcatgatgtagggaaagttgaatgtatatatttctaagaagaatttgtttagcagattacaagttggcaaaatagactgttcacagaaactaggcaaaaatttaaaaaaacattctagtctctaaaacccattactaatgattaacattaaaatatttgtaactcttagaaagggggcattactaagacgactttaacttgttatgaaatctttgttgtgtgatgcaggtacagtgcgcccattccaactggaatagcagtttgattttaattgtaaaactaaacttcgggaatatgtatgcccaaagtaagtaggatgagaatagtatacatgggatatggtccaatgaatttaagccccaagatacagctaaatacatttatgatttcataaaatctagtttagatagcattgtgatgcaatttccagaaatccatttgtgtttagagtaaataccatgtttagaagatgttttgtggtttggatttatatatttgtaaggtttttttaaaaaaatgttcgttttgtttgaaatgtaacattgagtaaattggtgagttatataatgagatttctagaaagctctggacatgggtacgatgtgttttgcttctctgtataatgtctacagtgataaacttgtgtctccgtgtattgtggcagtctttttttctagttaatttggctttagagagcaatctttgtatgacaccagaaaactcttcatgctattgaatgataaaaagataatgctttaatattttattcactgtgatactattttgtttgtctattaaattgttattatttccaaattt

SEQ ID NO: 177357 - DNA, 1366 bp, Homo sapiens
  Payload ID: 14801
  Gene Symbol: RNF183
  Gene Name: ring finger protein 183
  Uniprot ID: Q96D59
  ENST ID: ENST00000441031
  CDS Start-End: 275-853
ccccaccccccaggaagctctctggccttggctccaagcaggtgtgctcaagaggctgccgactgggccacctggcagccccaggtgctgcgtgcatgctgccatggagacaggcccctgggttggtggcaagaaggcagtctcccaaagctttgccgattcaggggagggagcaactggagcctcaggccctccagagtagtctgcctgaccaccctggagcccacagaagcccaggacgtctcccgcgaagcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattttaaaaaaaaacaaaaaaacgaaaagcttgaaggactgggagatgtggagcgacctccgggtgtgagtgtggcgtcatggaagggcagagaagcggttctgaccacagagctccacagcaagttgtgccaaagggctgcacagtggtatccaggaacctgactagcccaaatagcaagttgcatttctcactggagctgcttcaaaatcagtgcatatttttttgagttgctcttttactatgggttgctaaaaaaaaaaaaaaaattgggaagtgagcttcaattctgtgggtaaatgtgtgtttgtttctctttgaatgtcttgccactggttgcagtaaaagtgttctgtattcattaa

SEQ ID NO: 177358 - DNA, 1830 bp, Homo sapiens
  Payload ID: 14801
  Gene Symbol: RNF183
  Gene Name: ring finger protein 183
  Uniprot ID: Q96D59
  ENST ID: ENST00000297894
  CDS Start-End: 1100-1678
aaagcaaccaaagcttccagggtgtacaggaggtccaaagtcaccagaaggaagaagaaaacctgaaacagcgagagctggccaaacgctgctaagacctatgcaaataagacccacccacgctacctggaaatcgggcctgggaagtcagaaaacaaagcacatgcgtgcagggctgcacgaacggaggcggaggaggcggctccgagggagcagctgatcctgaaacagcagtggatccctgggagagcagcacagataaagatccaggcaataatgatgcttcctcctcttggacagccttttacagttctggccatggaacttcagagaaggtaggtctgatttggggggaaacaggagatcttgacgtgtagtaatacaagcttactggatggagtaaagttagaattttcaggtaagagaattaaaaaaaaaaaaaaaacttataatcttgcccccagagataaccactgctaatatctggttgtttatctctccagacattttttccattgcacacacacttttggaaattggattatatggtaatatggttttgttgctggttctttttcgcttaatgacattatatcctaggtatatatccatattaatagttttaccacatcatattaaaggctgcataatatctcttcctatggatggagcagaatctacttaatcaatgtcctattactggatgatgacgtagttctccatacgtcaccgttaaaccagcgcctggatgggcatctctttactcacatctttgcagaagtccttgatggtttccgtggaatcgattcccagtgggggaaatgatgagtcaaggttacatacagtttacggcctctgcagatcaactcttcaaattattcgaatgacccatatgagaaacagagaaaagccaagtatttctggttgaaacggagaagctgggctggagtgcgcctccctccaactccccgctttaactccctaaggttggtgggatggccagctctaagatctcagaaggctgaccagctgtgtgctaagaacaaagcagaaggcagcgaggacgtctcccgcgaagcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattt

SEQ ID NO: 177359 - DNA, 2312 bp, Homo sapiens
  Payload ID: 14801
  Gene Symbol: RNF183
  Gene Name: ring finger protein 183
  Uniprot ID: Q96D59
  ENST ID: ENST00000478815
  CDS Start-End: 1582-2160
cttcaaattattcgaatgacccatatgagaaacagagaaaagccaagtatttctggttgaaacggagaagctgggctggagtgcgcctccctccaactccccgctttaactccctaaggttggtgggatggccagctctaagatctcagaaggctgaccagctgtgtgctaagaacaaagcagaaggcagcgaggtttgtacacgctgattgcagttacttaggcacattaaaagatcagcgggtgactggactgaatctgatagtcggagctcttaagcttcgaagtaggtgactttcacagcaaccaaagtgctgagcaggcagcccctttgtgcaaggaggaggttccagccactttcgaagagaaatgagggccccagagagaggaagcccagaagactcagttaccctcttcacatctacaaagacgaaattgccaccctacctttccagaccagggactccaggtgttgaagggactgcccacaatctcacaggtgcttggcttccaggttcaattagttgccatgccctggggggaactcaggtcccccatcttcctccccaccccaccccccaggaagctctctggccttggctccaagcaggtgtgctcaagaggctgccgactgggccacctggcagccccaggtgctgcgtgcatgctgccatggagacaggcccctgggttggtggcaagaaggcagtctcccaaagctttgccgattcaggggagggagcaactggagcctcaggccctccagagtagtctgcctgaccaccctggagcccacagaagcccaggtgcgtgccctgaaggtttcccaggacaaagggagggaggaggagccagggtaggcagaggatggggaagaggctctggaaggggaagaggctctggaaggggaagaggctctggaagggctgatctggggactggggcagggaagcttctgcaaggcttccaggtaaggagaaaggcctttccaggggcttccttgccaggccaaggactgggtgagtaggatgtggagggttggccctctagctcaaggggaggagggaaagagggctggcatttgtccccataggagggacagaccagggaattcacaaaacccatctctgcgctagtcagggatttgaggtagcagggaaggaaacatttgtcctgtagcaaaacccgcagactgcagcttacccccagctccctggattcagggcagccaagggcacagacaatgaccataaggagcatttgcgtccagctccaaagcccagggcgacatctgctccaatgccggctctcttgggggctcttggtaggggtggcccaggccttcaccttgacagaggggaggctgtaggagcatttgactcaactcgatgggttaggaactggtgatcaagaacaaaacgcttttgaacctaagtaaaacgtggtgattacacctttcaacacccacagaacactttgccccaggccaagcacaaggatgggacttcatggctgttcctttgctcctttcccccttctgccaggacgtctcccgcgaagcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattt

SEQ ID NO: 177360 - DNA, 849 bp, Homo sapiens
  Payload ID: 14801
  Gene Symbol: RNF183
  Gene Name: ring finger protein 183
  Uniprot ID: Q96D59
  ENST ID: ENST00000416588
  CDS Start-End: 108-686
tggaaggggaagaggctctggaagggctgatctggggactggggcagggaagcttctgcaaggcttccaggacgtctcccgcgaagcctccccgtgtgtggctgaggatggctgagcagcagggccgggagcttgaggctgagtgccccgtctgctggaaccccttcaacaacacgttccatacccccaaaatgctggattgctgccactccttctgcgtggaatgtctggcccacctcagccttgtgactccagcccggcgccgcctgctgtgcccactctgtcgccagcccacagtgctggcctcagggcagcctgtcactgacttgcccacggacactgccatgctcgccctgctccgcctggagccccaccatgtcatcctggaaggccatcagctgtgcctcaaggaccagcccaagagccgctacttcctgcgccagcctcaagtctacacgctggaccttggcccccagcctgggggccagactgggccgcccccagacacggcctctgccaccgtgtctacgcccatcctcatccccagccaccactctttgagggagtgtttccgcaaccctcagttccgcatctttgcctacctgatggccgtcatcctcagtgtcactctgttgctcatattctccatcttttggaccaagcagttcctttggggtgtggggtgagtgctgttcccagacaagaaaccaaacctttttcggttgctgctgggtatggtgactacggagcctcatttggtattgtcttcctttgtagtgttgtttattttacaatccagggattgttcaggccatgtgtttgcttctgggaacaattttaaaaaaaaac

SEQ ID NO: 177361 - DNA, 2946 bp, Homo sapiens
  Payload ID: 14802
  Gene Symbol: RNF185
  Gene Name: ring finger protein 185
  Uniprot ID: Q96GF1
  ENST ID: ENST00000266252
  CDS Start-End: 110-520
agtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcacagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacatt

SEQ ID NO: 177362 - DNA, 3171 bp, Homo sapiens
  Payload ID: 14802
  Gene Symbol: RNF185
  Gene Name: ring finger protein 185
  Uniprot ID: Q96GF1
  ENST ID: ENST00000326132
  CDS Start-End: 160-738
gtccgcgtaggaggggtcggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcacagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacattactatga

SEQ ID NO: 177363 - DNA, 3315 bp, Homo sapiens
  Payload ID: 14802
  Gene Symbol: RNF185
  Gene Name: ring finger protein 185
  ENST ID: ENST00000426256
  CDS Start-End: 142-615
ggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagaggggtgaggaacattctaggagaagcttctacaaatgagctgatggctttagaagtttccttcttagccttacaatttttctccttgattataaaagtaaaggaaaacttgtaaaatacagaaaggaaaagagggggaaaaaaatcacttataaccacaccaatccagaggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatggtatttctggaaattttcatgtctttaaataccccttggtaagttgcttctgaagccagtgggggctcctcagatagagaggttcccctttcaaatcccagtgccgctctgttctctttccttcccctcccactccccctcttcttcctctgtagagatgcaagaaattgctgtcccataaaaatcataattgcagtagctaaagctggggtcacttcgtgaattcaccagagactcaaagatcttttattggctctgggctgtgctcagtgtctttggcctcagagaacaacttgaatgacttcctggtttcctggcataaattattcctggtgagacatgtggcttaactcacaggtttcccatcagctttctccctaaaactatgttcatctgcctctctctgccagagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcacagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacatta

SEQ ID NO: 177364 - DNA, 2737 bp, Homo sapiens
  Payload ID: 14802
  Gene Symbol: RNF185
  Gene Name: ring finger protein 185
  Uniprot ID: Q96GF1
  ENST ID: ENST00000518626
  CDS Start-End: 142-720
ggaggtcttacccaacagattgacgcggcgttagtattggccgtgtacccgaaaaactgattgactgggctggcgttaactgtgcggaggcaggatttccctggggaaagtcttcactcagagcttcgctgacagccaaggatggcaagcaaggggccctcggcctctgcatctcctgagaactccagtgcaggggggcccagtgggagcagcaatggcgctggcgagagcggagggcaggacagcactttcgagtgcaacatctgcttggacacagccaaggatgccgtcatcagcctgtgtggccacctcttctgttggccgtgtttacatcagtggttggagaccagacctaacagacaggtgtgtcctgtttgcaaagctggcatcagccgagacaaggtcatccccctctatggaaggggcagcactgggcaacaggaccccagagagaagacccctcctcgtcctcaaggacagaggccagagccggagaatagagggggatttcaaggatttggatttggagatggtggcttccagatgtcttttggaattggggcatttccctttgggatatttgccacagcatttaatataaatgatgggcggcctcctccagctgtccctgggacaccccagtatgtggacgagcagttcctgtcacgcctcttcctatttgtggccctggtgatcatgttctggctcctgattgcctaatgctgggctcctgcctacatccgtggcagggctctggactggtgacgtgccaccccaactcctggtgtttggcttcctggctaatcttgactcctggaatcagtgggatcagtaacacatcaaggagtcttgtttcttcatcagagctttggaactcgagaccagttggcgatgacccctgaatatcgccaccgctgtaaacactctataacttcaggccttggcattgagtcatctctcatgggtgacaccatgaaatcttgtttcagccagttctgcaggtcctgactctgcagagggaagaggcagaaagagagaaactgtcagagtataatttcacctgagtttaatattacagaaacaaagggatgcaccaaatgagaacatacagccgagaatactgccgaagctgagactgactactgtgcattaggaaagacctggagtcaggactttggtgggatttggagctccgaggcagtaataactgaacaagcagccctgtcccctaggctgcagaagcttgaatgcatcctctcccagaacctgccacaggaaactgggggctttgtcaggtcagcccaactgcatgcaaaagaccaccatcctcagaagccaagttgtcttttatgaagaggcaaggaaaggggaaacccacatgtgaccctgattttggtatggcttgatagagttccctgaaaactccttgtatgtgtgctaaaaccagggaagcatgtgactgccaagcaggcaacccctgatgatttgtaaagccaggtggcagggccttggggagccccagcacaatgatattgtgtggtcttccctcctgtggaatcgaggggaaattattcttcccaataccttgatttgattttcagtttcataagcttcttcctctgaatcttattgagggactatggtaccaagcaggtaggactgttcacctggtggaacagttcttgctctgccttctaggcttcatcccagaaatccagcctctttctggagaccccaaagctggagggagatgggctttcctctgggcctctctcctactttgccatccacactgctcctggctaaccccagcaataaccaacaaatggtaggaagccccatctattgctttttctcaattatgactgcatagtttatggaaacaaagatcttgaggaagatgagggaagccctcccctcttcacagtccccatctcttctcctttgtacctgtcaacaccagagttcagtgtttaaacagacaaaatataaagtattgagtaggtggttcatatgccgaatccacttggtaggaagaaaccaccagctttatagtgtgcctgatagattttaaacattcctgggcacccactcaagagtgctctttttatcaccttctggaaatccgcaaagttgcaggggcctctggagtgtctcttctctagagagaattggtgggacccccctcagtgcagtggccccaactagtggagggagagaggacttaagtcagatggactcaacagaaatgggtttccagaagaataatgaaaagttgtgggtaggaaaatgaatcatttggactcttcaatgaaatggagtgagcccaggagagctcagccaacagaggcactctgggaacctgttagtaaagccaggctggccaaatgccatttgattttgaacctcgtaggtccccactcaccctctgccaggagctaagtaaggcaggagagctgacttgggactcctggctcggccccaacagggagcccccttcccaccatccctcggcaagctcaccacctcatccttctgccaaggcagctttcctttcttttgtgtgttttctgtgttcttagcctccaccctcctcctgccacccttgtggactaggaccaggtcctgaccccagtcagaaaatgatgatatgtacagtggcacaccttaaccagtcactaattttcactgttgtgaaagtgatttgatttagaattaaacaaatggttttacatta

SEQ ID NO: 177365 - DNA, 1250 bp, Homo sapiens
  Payload ID: 14803
  Gene Symbol: RNF186
  Gene Name: ring finger protein 186
  Uniprot ID: Q9NXI6
  ENST ID: ENST00000375121
  CDS Start-End: 178-861
aagaaacaagctgggcagctctgggagagaggagtgtcagacagctgttgtcaacaggcacctggccagagtgaaaaggaggggcagattccatccaagtcccagcggcgccagctgacactctctgccaatgcccaggtgctgagcgacagtgtcccaccggtccctgtgcccagaatggcctgcaccaagaccctgcaacagtcccagcccatctccgcaggagccaccacaaccaccaccgctgtggcccctgctgggggtcattctggctccacagaatgtgacctggagtgtctggtgtgccgggagccctacagctgtccccggttgcccaagctgctggcctgccagcatgccttctgcgccatctgcctgaagctcctgctgtgcgtgcaggacaacacctggtccatcacctgcccgctgtgccgcaaggtcaccgccgtccccgggggcctcatctgcagcctgcgcgaccatgaggcggtggtggggcagctggcccagccatgcacagaggtatcgctctgtcctcaggggctggtggatcctgctgacttggcagcaggacaccccagcttggtgggagaggatggacaggatgaagtaagtgcaaaccacgtggcagcccggcgcctggccgcgcacctactcctgctggccttgctcattatcctcatcgggcccttcatctacccgggtgtcttacgatgggtgctcaccttcatcatcgccctggccctgctgatgtccaccctcttctgctgtctccccagcacccggggcagctgctggccctcctccaggactctcttctgcagagagcagaaacacagccacatctcttccattgcctgagtgccctctgatgaggctatccctgcagccctttctgcccttgggcccccggacttccacaatgaacagggtaaggggttacggactaagactggctcctttgggaaatcacatgccagcgggacttgcaagccacaaccgagatggccagcctgggtcaagaattacacgcttggatgacaggcttgcacttgcccttgggatagcatagctaaaactgttggtggctaggggagcagacacaaactacttgaacatgacaagatgggggaagctcctgttcctcttattccaatgttcttggtttttctttatataacttgatgaaagtattgcagtattgatgccattgtagaatagaactggaattccattctttttgcaattta

SEQ ID NO: 177366 - DNA, 3017 bp, Homo sapiens
  Payload ID: 14804
  Gene Symbol: RNF187
  Gene Name: ring finger protein 187
  Uniprot ID: Q5TA31
  ENST ID: ENST00000305943
  CDS Start-End: 429-1136
ccgcaggcagtagagtgaagcgcgcagctgccaggacttgcgcggtgacgtgcgccgctgccaggaccttgcaggtggagagcatagttgccaaaatcaaggcggaggagcgcaccgccgctaggatccaggcggagaagcccaccgcggccaggacctaaggatgcagtacactgctgccaggatcttgtctgtggagcgcagcgcggccaggacctccggctgcagcacaccgctgccaggatcttatcggcagagcgctccgcggtccggaccccgccccgtgcgcgtccccgaccccgccccgtgcgcgtccccggcgttggcgtcttcgtcctgttgctggtctccgtccggtcgccggccgtctaggtctccggccctccccagccgctcctgcgcccttgccggccccgccgcccgcagccctggcgctccctgcgggccccgccgaggccgcctgcgccctgtgccagcgcgcgccccgggaaccggtgcgcgccgactgcggccaccgcttctgtcgggcgtgcgtggtgcgcttctgggccgaggaggacgggcccttcccgtgccccgagtgcgccgacgactgctggcagcgcgccgtggagcccggcaggcccccgctcagccgccgccttctggcgctcgaggaggcggccgcggcgcccgcgcgcgacggcccggccagcgaggccgcgctgcagctgctgtgccgcgccgacgccggcccgctctgcgccgcctgccgtatggctgcgggccccgagccgcccgagtgggaaccgcgctggaggaaggcgctgcgcggcaaggagaacaaggggtctgtggaaatcatgagaaaggacttgaatgacgcccgggacctgcatggccaggcagagtcagcagctgcagtgtggaagggacacgtgatggaccgtaggaagaaggcactgaccgactacaagaagctgcgggccttctttgtggaggaggaggagcatttcctgcaggaggctgagaaggaggaggggctccctgaggacgagctggctgaccccactgagcggttcaggtcactgctgcaggcggtctcggagctggagaagaagcatcgcaacctgggcctcagcatgctgctgcagtgatggcgccaacccgtggcagtcccagagctggaggcaggaggatggatcctcatctccatgggaagtgtcagcgtgtggctgccagggaagcgtggcaggcgcctggccttgggtccatctacatagttgcgtgtttcaacaatgtccatttatccttcaccccgaggcgtgttttgggggctgcaaacacctcccggtagaggctggacctgaggacccttcccacctgtgcccgtcccttcctgaagtcctagccacagcccatcctccatgagtcccggcagctctgggtcatgcccttccctggtcacccatctgcccctcacctcgtcatccagggacccagaccctgcaccttccatgtgggcccacagatccttggcaggtacctgaggtgcaccattgagtgtcggatttggggttagcatccagaaagaagaatgcgcatgacgctctgtgaaggctggaactcaggtcttcagggagagaaaggaagactggattgcaccttgatgcctcctgaggaggcggcccccctcttgaggtgggcgtgggcccggcccagccttatccaagtcgctctgtccacctcccccttcctggcccccaccccactcctgtgcctcccaggagccctccctgtgctccacctgcctccgcagaaggaagcctctttctctgtttccctgggtgagggggctggcaggtggctaaccccatttagcatctccaggccctgccatcgtgtctcatcttgctgttatctctagctctttccctcctcccatttcctttagtagttgaattttgcaaagcttgtagcagtagctcagttgcctgcagcatccttgtgtgtagataaattagtcgacagaaactcagcactggggacaggattgcaaagtcggggacatagatgcagacagttgttgagatttggggatagccgggcttgtgagcggtgcccatttccagatgaagcctttcagcccttctgagtccccggcccttggtgcgatgtctgtgagtttgacctgcccagcgtgtgggctggctcaatgctgaataaagtgggtttgtgtcagctcgtttgcttcgtctccgtgtgtccacctggcctcttccccctgccctggccaccctccagtgtcaaaggaaacttcctcgtgacacgtgctaaagcatggtgaggaggactttgattgggaccattgagatgggtgtgggaccctttccttggggcctggggggagatggggctccaccccgacgtagcagggcaggggttggaggagcgaggagcagtatagggtccatgggtgggaatgactgtgaggagacatcagggctgagggggctctggctaaacccacctcacagagtccttgctgcaggcaggcagggcgatcagacattggctgcaaacggtcagagaggaacccagtcaggtaccattgagggtggtcagatattatggttaaccaaattagggttcttgctaaaactggatttcataagaaagggcaaagagggccctaggagaagattccagagcctggccagagtttggccaagtagagaatctttgtcagcacgccaacaacatcccgaccctgagacctccagtttgtctttctcactgtctccgcctgctgcagtctgctgtcatccctgagcatccctgcccctgccctgcacacctgtgatgcttgcccggacaggtcctgatggcagagtctcccacaacatcagtgtctccacatcaccaggtccgacagtggcttcaccatcctcacctaacctagctgaccagcaacatcccaccctgtcaatcacaacctctttctatttaagaaaattatatatttatggggcacagtg

SEQ ID NO: 177367 - DNA, 4285 bp, Homo sapiens
  Payload ID: 14805
  Gene Symbol: RNF19A
  Gene Name: ring finger protein 19A, RBR E3 ubiquitin protein ligase
  Uniprot ID: Q9NV58
  ENST ID: ENST00000341084
  CDS Start-End: 555-3071
gggggccgcagtcggggccacccgggtgcagcggggcggctcctgcgcgggcgcggaacgaacgtgcgcaagggaacagccgcgtccagagccgcccgcagcgggcccggtgggcgtgacgccatgacgcacagcacgcgggcggcgcgctggggcggggcggccgggggcgggaggaagaagtgggaggaggaggaggggaaagcgggggctgcgggagggggaggtggtagttgcggcgctggttcccgggagcagccgtcgagccacaactgcggaggaggagttcgggaaagcggccgtcgggactcctcccctccgtcgtctccgccccggttgagaggcgcctcggcgcatcggagggaccctcccccgcgcttcctcaggctgctgtcgccgctgctgggagatgggcctactcgcccgccaccctgcgctgccgccgctctgaggagttaaagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaa

SEQ ID NO: 177368 - DNA, 432 bp, Homo sapiens
  Payload ID: 14805
  Gene Symbol: RNF19A
  Gene Name: ring finger protein 19A, RBR E3 ubiquitin protein ligase
  ENST ID: ENST00000432381
  CDS Start-End: 165-432
gacacattctcccctcaagccccagtgggagcacggcccagctggattttggacttctggcctccagaactaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatg

SEQ ID NO: 177369 - DNA, 4330 bp, Homo sapiens
  Payload ID: 14805
  Gene Symbol: RNF19A
  Gene Name: ring finger protein 19A, RBR E3 ubiquitin protein ligase
  Uniprot ID: Q9NV58
  ENST ID: ENST00000519449
  CDS Start-End: 318-2834
atagtcaccagaagctggaagagtcaaaggacacattctcccctcaagccccagtgggagcacggcccagctggattttggacttctggcctccagaactagacagggcctcactgtgtcacccagggtggaatacagtggtgtgatcatagctcactgcagcctggaattcctgggctcaagcaaccctgccacctcagccttccaagtagctaggactacagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgtactgctgc

SEQ ID NO: 177370 - DNA, 317 bp, Homo sapiens
  Payload ID: 14805
  Gene Symbol: RNF19A
  Gene Name: ring finger protein 19A, RBR E3 ubiquitin protein ligase
  ENST ID: ENST00000517584
  CDS Start-End: 143-317
gacacattctcccctcaagccccagtgggagcacggcccagctggattttggacttctggcctccagaactaacatccatgatagcagtcttctgtaaatcgaacttttcaagaattctctgaaggaaccaacattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatg

SEQ ID NO: 177371 - DNA, 792 bp, Homo sapiens
  Payload ID: 14805
  Gene Symbol: RNF19A
  Gene Name: ring finger protein 19A, RBR E3 ubiquitin protein ligase
  ENST ID: ENST00000523167
  CDS Start-End: 323-792
atgacgggccgaggcggcgctcccctcgagctgtctcctgcccctaaagcgggggagacccaagggcggttgccgcggggaggcggcgggggcggaacgcattcctgacgggtgaaatcggctctaacgggaccgatttccgggcctcgctgcaaatttggagccgggacatcgccccgcaagccgtgctgcctggggccttagggaggggagctgtgttcggaggaagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtgga

SEQ ID NO: 177372 - DNA, 612 bp, Homo sapiens
  Payload ID: 14805
  Gene Symbol: RNF19A
  Gene Name: ring finger protein 19A, RBR E3 ubiquitin protein ligase
  ENST ID: ENST00000522369
  CDS Start-End: 273-612
ctcttctctcattggcactgcctgtctactgccgagggcatttgagtgtgggacccatgccctgcatttcttcgctaccccacagcttctgctcatgaatccagctcaaatgtcagaagaattgacgttagtttgagagaccaaactaagttacagcctctttggtttctgttactctgaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacct

SEQ ID NO: 177373 - DNA, 547 bp, Homo sapiens
  Payload ID: 14805
  Gene Symbol: RNF19A
  Gene Name: ring finger protein 19A, RBR E3 ubiquitin protein ligase
  ENST ID: ENST00000523481
  CDS Start-End: 504-547
actcgcccgccaccctgcgctgccgccgctctgaggagttaaaggtagcctcaaaatcaagtgacaagtgtctttgtaagggacaagtagacccattacagagaagacgacgcgcagaaaaggaggaagcagtgtgctcatggaggcggagattggagtgatgtaaccgcaagccgaggaatgcttatagtcaccagaagctggaagagtcaaaggacacattctcccctcaagccccagtgggagcacggcccagctggattttggacttctggcctccagaactagacagggcctcactgtgtcacccagggtggaatacagtggtgtgatcatagctcactgcagcctggaattcctgggctcaagcaaccctgccacctcagccttccaagtagctaggactacagaacatccatgatagcagtcttctgtaaatcgaacttttcaagaattctctgaaggaaccaagtaggatattcttacatcatgacttaatgtgaatgcaagaacaagaaataggttttatctctaaatataatgaagg

SEQ ID NO: 177374 - DNA, 817 bp, Homo sapiens
  Payload ID: 14805
  Gene Symbol: RNF19A
  Gene Name: ring finger protein 19A, RBR E3 ubiquitin protein ligase
  ENST ID: ENST00000519527
  CDS Start-End: 321-817
gcctgtctactgccgagggcatttgagtgtgggacccatgccctgcatttcttcgctaccccacagcttctgctcatgaatccagctcaaatgtcagaagaattgacgttagtttgagagaccaaactaagttacagcctctttggtttctgttactctggctggtcttgaactcctggactcaagtgatccaaccacctctgcttctcaaagtgctaggactacagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggataga

SEQ ID NO: 177375 - DNA, 4124 bp, Homo sapiens
  Payload ID: 14805
  Gene Symbol: RNF19A
  Gene Name: ring finger protein 19A, RBR E3 ubiquitin protein ligase
  Uniprot ID: Q9NV58
  ENST ID: ENST00000616528
  CDS Start-End: 111-2627
tggtttctgttactcagaacatccatgatagcagtcttctgtaaatcgaacttttcaagaattctctgaaggaaccaagtaggatattcttacatcatgacttaatgtgaatgcaagaacaagaaataggttttatctctaaatataatgaagggctgtgtgtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtggatatgctgtgatagcatttggatgtgccagctgtccaaaattaacttgtgggcgagagggctgtggaacagagttttgctaccactgtaaacagatttggcaccccaaccagacctgtgatgctgctcgacaagagagagcccagagcttacgtttgagaactatacgttcttcatccattagttatagtcaagagtctggagcagcagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaagattcacaatcgctatgaaggcaaggatgtttcaaagcacaaacggaatttggccatagcaggtggtgtaacgttgtctgtaatcgtgtctccagtagtagctgcagtgactgtaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggttggaagtacaagcagatgtacagaaagaacggtacagtctaagtggagaatctggcacagtcagcttgggaacagttagtgataatgccagcaccaaagcaatggcaggatccattctgaattcctacatcccattggacaaagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttatataaagcttaatgcagctcatttgctaccatttggatacttagacactttgagcaagattgtggcagtttttgcacaactttgaaatagaaatacctggtactctatcttgtttattgttgatgccatcttagaggaaaaaatgtaaaggtaagtaattaagcatatgacagcaacaaataagatacataaaactacaaaataaagtcccattaggttataagtattacaaaaaatccacctttctctaaggggaagtttgtaccccattgattcttggtgcctttgggatcgactgggttttaatggcctagttatttgaggattttgctgtgttgttttccatgtcttctctggtcaccttggattatatataaaaatacaggaaatagataaacatgaatgtgattaataatgctgaaaaagtattagcctaccaaagacacactcaggctttagtgaataactttacataacctcagtttttaacacatgcatatcttctccaaccatgaaatcaaagcacggtgcagaacttgtaccaagtacaaaaggtccatgtatgattagcattattttcttttgcttttgtttatggacaatgttcagctgacataagcagaagttggccaaaatactgcctgtactgttaatttcctgtataattcacttaaataaaagcaggttaacctcaatgatagcagttaaaatgttctatcttatgtatttcttttaagtattaccattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgttaaataaatgtaaatactaatgtactgctgcc

SEQ ID NO: 177376 - DNA, 2334 bp, Homo sapiens
  Payload ID: 14806
  Gene Symbol: RNF19B
  Gene Name: ring finger protein 19B
  Uniprot ID: Q6ZMZ0
  ENST ID: ENST00000235150
  CDS Start-End: 1-2196
atgggctccgagaaggactccgagtcgccgcgctccacatcgctacatgcggccgcacccgaccctaagtgccgcagcggcggccggcgccggcgcctcaccttgcacagcgtcttctctgcctcggcccgcggccgccgcgcccgggccaagccgcaggccgagccgccgcccccggctgcgcagccgccgcccgccccggcccctgccgcggcccagggcccgccgcccgaggcgctgcccgccgagccggccgccgaggccgaggcggaggccgcggcggcggcggcggagcctgggttcgacgatgaggaggcggcggagggcggtggcccgggcgcggaggaggtggagtgtccgctgtgcctggtgcggctgccgcctgagcgggccccgcgcctcctcagctgtccgcaccgctcgtgccgggactgcctccgccactacctgcgcctggagataagcgagagcagggtgcccatcagctgccccgagtgcagcgagcgactcaacccgcacgacatccgcttgctgctcgccgacccgccgcttatgcacaagtacgaggagttcatgctgcgccgctacctagcctcggaccccgactgccgctggtgcccggccccggactgcggttatgctgttattgcctatggctgtgccagctgcccgaagctaacttgtgagagggaaggttgccagactgagttctgctaccactgcaagcagatatggcatccaaatcagacatgcgatatggcccgtcaacagagggcccagactttacgagttcggaccaaacacacttcaggtctcagttatgggcaagaatctggaccagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaa

SEQ ID NO: 177377 - DNA, 2598 bp, Homo sapiens
  Payload ID: 14806
  Gene Symbol: RNF19B
  Gene Name: ring finger protein 19B
  Uniprot ID: Q6ZMZ0
  ENST ID: ENST00000356990
  CDS Start-End: 1-1764
atgggctccgagaaggactccgagtcgccgcgctccacatcgctacatgcggccgcacccgaccctaagtgccgcagcggcggccggcgccggcgcctcaccttgcacagcgtcttctctgcctcggcccgcggccgccgcgcccgggccaagccgcaggccgagccgccgcccccggctgcgcagccgccgcccgccccggcccctgccgcggcccagggcccgccgcccgaggcgctgcccgccgagccggccgccgaggccgaggcggaggccgcggcggcggcggcggagcctgggttcgacgatgaggaggcggcggagggcggtggcccgggcgcggaggaggtggagtgtccgctgtgcctggtgcggctgccgcctgagcgggccccgcgcctcctcagctgtccgcaccgctcgtgccgggactgcctccgccactacctgcgcctggagataagcgagagcagggtgcccatcagctgccccgagtgcagcgagcgactcaacccgcacgacatccgcttgctgctcgccgacccgccgcttatgcacaagtacgaggagttcatgctgcgccgctacctagcctcggaccccgactgccgctggtgcccggccccggactgcggttatgctgttattgcctatggctgtgccagctgcccgaagctaacttgtgagagggaaggttgccagactgagttctgctaccactgcaagcagatatggcatccaaatcagacatgcgatatggcccgtcaacagagggcccagactttacgagttcggaccaaacacacttcaggtctcagttatgggcaagaatctggaccagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacaggtttagcatgatccatgcatgactcagcaaagtggattttgtctccacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataa

SEQ ID NO: 177378 - DNA, 2560 bp, Homo sapiens
  Payload ID: 14806
  Gene Symbol: RNF19B
  Gene Name: ring finger protein 19B
  Uniprot ID: Q6ZMZ0
  ENST ID: ENST00000373456
  CDS Start-End: 1-2199
atgggctccgagaaggactccgagtcgccgcgctccacatcgctacatgcggccgcacccgaccctaagtgccgcagcggcggccggcgccggcgcctcaccttgcacagcgtcttctctgcctcggcccgcggccgccgcgcccgggccaagccgcaggccgagccgccgcccccggctgcgcagccgccgcccgccccggcccctgccgcggcccagggcccgccgcccgaggcgctgcccgccgagccggccgccgaggccgaggcggaggccgcggcggcggcggcggagcctgggttcgacgatgaggaggcggcggagggcggtggcccgggcgcggaggaggtggagtgtccgctgtgcctggtgcggctgccgcctgagcgggccccgcgcctcctcagctgtccgcaccgctcgtgccgggactgcctccgccactacctgcgcctggagataagcgagagcagggtgcccatcagctgccccgagtgcagcgagcgactcaacccgcacgacatccgcttgctgctcgccgacccgccgcttatgcacaagtacgaggagttcatgctgcgccgctacctagcctcggaccccgactgccgctggtgcccggccccggactgcggttatgctgttattgcctatggctgtgccagctgcccgaagctaacttgtgagagggaaggttgccagactgagttctgctaccactgcaagcagatatggcatccaaatcagacatgcgatatggcccgtcaacagagggcccagactttacgagttcggaccaaacacacttcaggtctcagttatgggcaagaatctggaccagcagatgacatcaagccatgcccacgatgcagtgcatacattatcaagatgaatgatggaagctgtaatcacatgacctgtgcagtgtgtggctgtgaattctgttggctttgtatgaaagagatctcagacttgcattacctcagcccctctggctgtacattctggggcaagaagccatggagccgtaagaagaaaattctttggcagctgggcacgttgattggtgctccagtggggatttctctcattgctggcattgccattcctgccatggtcattggcattcctgtttatgttggaaggaagattcacagcaggtatgagggaaggaaaacctccaaacacaagaggaatttggctatcactggaggagtgactttgtcggtcattgcatccccagttattgctgcagttagtgttggtattggtgtccccattatgctggcatatgtttatggggttgtgcccatttctctttgtcgtggaggcggctgtggagttagcacagccaacggaaaaggagtgaaaattgaatttgatgaagatgatggtccaatcacagtggcagatgcctggagagccctcaagaatcccagcattggggaaagcagcattgaaggcctgactagtgtattgagcactagtggaagccctacagatggacttagtgttatgcaaggtccttacagcgaaacggccagctttgcagccctctcagggggcacgctgagtggcggcattctctccagtggcaagggaaaatatagcaggttagaagttcaagccgatgtccaaaaggaaattttccccaaagacacagccagtcttggtgcaattagtgacaacgcaagcactcgtgctatggccggttccataatcagttcctacaacccacaggacagagaatgcaacaatatggaaatccaagtggacattgaagccaaaccaagccactatcagctggtgagtggaagcagcacggaggactcgctccatgttcatgctcagatggcagagaatgaagaagaaggtagtggtggcggaggcagtgaagaggatcccccctgcagacaccaaagctgtgaacagaaagactgcctggccagcaaaccttgggacatcagcctggcccagcctgaaagcatccgcagtgacctagagagttctgatgcacagtcagacgatgtgccagacatcacctcagatgagtgtggctccccccgctcccatactgcagcctgcccctcgacccccagagcccaaggtgcaccgagcccaagtgcccatatgaacctctctgccctagccgagggacaaactgtcttgaagccagaaggtggagaagccagagtatgaagtggaatgaatgctcctgttctgagaagcacacttgtaactgcatcttttggaatttttttttttttttttccaaggggtagagatttatgtattttatttcacagattctctggtcacaggtttttgcccagggaaattctgagaaattcacaatttcttaccagataaaacatgaaaagtttgccgttagttcccctcccctcccctccctctttttagttttaatttattggttaaactgatggcagcaatccatgaggtgtgtcaaagagtgtacatatgtatgtgtgtatattgaatgctaaacatattactgaaagacacattttaataaagatttctgtcataattcaactta

SEQ ID NO: 177379 - DNA, 1677 bp, Homo sapiens
  Payload ID: 14807
  Gene Symbol: RNF2
  Gene Name: ring finger protein 2
  Uniprot ID: Q99496
  ENST ID: ENST00000367509
  CDS Start-End: 127-921
cccgagctccattgcggaagctgaggctcgccatattgtgcggcggcgccggcgtccgcggcagctgataccagagtcttgctccggccgcggccagcggagccctgggctggggcaggagccgcaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgtttttttttttccccacaaagtgtgtttccacttggagcaccattttgacccaggaatttttcatagtttctgtattcttataagattcagttggctgtccttttcctgctcccctcaaaagatttttagtcatacagaatgttaaatattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtat

SEQ ID NO: 177380 - DNA, 3606 bp, Homo sapiens
  Payload ID: 14807
  Gene Symbol: RNF2
  Gene Name: ring finger protein 2
  Uniprot ID: Q99496
  ENST ID: ENST00000367510
  CDS Start-End: 289-1299
cggcgcaccctccctcgcgccgcgggcctccccgcgccgtgcacgtcctcgtcccgcgcctccgcccctcgctcgctcgctccttcccgccctccccgcagcgccggccgagccggcttcccctcagtctctcatgaatattgagcggcccctgttgtatttcccgagctccattgcggaagctgaggctcgccatattgtgcggcggcgccggcgtccgcggcagctgataccagagtcttgctccggccgcggccagcggagccctgggctggggcaggagccgcaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggcaacaaagaatgtcctacctgtcggaaaaaactagtttccaaaagatcactaaggccagacccaaactttgatgcactcatcagcaaaatttatccaagtcgtgatgagtatgaagctcatcaagagagagtattagccaggatcaacaagcacaataatcagcaagcactcagtcacagcattgaggaaggactgaagatacaggccatgaacagactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgtttttttttttccccacaaagtgtgtttccacttggagcaccattttgacccaggaatttttcatagtttctgtattcttataagattcagttggctgtccttttcctgctcccctcaaaagatttttagtcatacagaatgttaaatattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtatacgtttgagagtgcttttttttgtattagttctgctgtcacttcatttcctgtattatatgtgatgtttttccccattaaaataccagagataatggagatattttgcactttagccttgatgaaaagtacaagatatgttcaaagcttccctaatttttttcttatttgtagccacataagtttcaagaataacatggcacacagaacaatggaaaaaagtttgtttccattggaaaattatatcattttgggttgccacatcagtttataaatttggcgctcttttaattacactctgtagaaggttaatagagcttgagccctgctttaatatgtagtgaaagataattctgtagaaaaacgtcagccagtagggtaaagtcattctactgttcttaatttttatattgaggaacaatattgggtgtttgggagccagaaagctttgttgacagatcagaaataagattgacttgggtgttatatttcatctctctccagactctaggtatatttccaactttatatatcacagtatttaaaaagacatgtttgcattgagaaattaaccctaaagggttttcaatagggtgtagacctccagtacctttgtaactaaagtctgtctagtcattgtaaatatttatctgtcagttttgacagattggggccagcttgatgttttaaatcttcagcccggtatgaaaacttaaaggtatatattcaattttttaccattttatggaaaatatttaaaatctgtttttacagggttttttttttttttttttttttgtaatctgtgccatgaaatttgaaaaccaccaaaaatcaagggaacttttatatattcaattccttttctggtgtaatgttaaagttgtatagattattaatgcatgcccactgaatataaccctggttttgtgataaaactgcttagattttgttgatgacattagattagtagttgcattaaataactaaattcccattgtgattaattgaaattttgtctttaagcagagagttatttgtgactataagctttgtgcttagagaatgtatgtgtttttatctgtcagtatgggaggatataaactgcatcattagtgaaattattggttgtgtaatcctttgtgaaatataattctaggtatttgatagggtattgagtgtattttgtgtgtgtgtggatgtgtgttttggggtacggggagaggcgatgctattggccatcactaccaaccagggtttcaaaaagtattacctaagtaatttcttttatcactatctcaactgaggaagaaaaggctcaccacaagtggtgtgaaggctttgggtacttagttctaaatttttttatggtaacatatacatagccacatttacagttttaaccattttaaggcatgtaattcagtggggttaggtacattcacaatgttgtgtaatgatcaccgctgtctacttgtaaaactttttcatcaccccaaacagaaactctgtgtgcaattaaagtaatgcatttctcttcttcttaacccct

SEQ ID NO: 177381 - DNA, 939 bp, Homo sapiens
  Payload ID: 14807
  Gene Symbol: RNF2
  Gene Name: ring finger protein 2
  ENST ID: ENST00000453650
  CDS Start-End: 203-939
ggatgtgtgtctgcatcgtgggggtggggtagggggcactttgtgcagatatcgctccttccttctggggggtcggagtcggggttccagtgtagaggagctcctcgacctcggggttcctcggggagaccccttcagcttcacacattcctggagtgccgcctcctgctctggagtatctgttgctgctttctaaaacccaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggcaacaaagaatgtcctacctgtcggaaaaaactagtttccaaaagatcactaaggccagacccaaactttgatgcactcatcagcaaaatttatccaagtcgtgatgagtatgaagctcatcaagagagagtattagccaggatcaacaagcacaataatcagcaagcactcagtcacagcattgaggaaggactgaagatacaggccatgaacagactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgag

SEQ ID NO: 177382 - DNA, 596 bp, Homo sapiens
  Payload ID: 14808
  Gene Symbol: RNF20
  Gene Name: ring finger protein 20, E3 ubiquitin protein ligase
  ENST ID: ENST00000374819
  CDS Start-End: 54-596
agagctggaatctctgcacgggccttggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggggaagggcaagagccagctttctctttccttgctactttggccagcagttccagtgaagagatggagtctcagctgcaggaacgtgtggagtcttcc

SEQ ID NO: 177383 - DNA, 3940 bp, Homo sapiens
  Payload ID: 14808
  Gene Symbol: RNF20
  Gene Name: ring finger protein 20, E3 ubiquitin protein ligase
  Uniprot ID: Q5VTR2
  ENST ID: ENST00000389120
  CDS Start-End: 91-3018
ggaagttctgccttgtctccgccgcgggtcaggggtgagagctggaatctctgcacgggccttggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgaccgagagagaggggaagggcaagagccagctttctctttccttgctactttggccagcagttccagtgaagagatggagtctcagctgcaggaacgtgtggagtcttcccgccgagccgtgtcccagattgtgactgtttatgataaattgcaagaaaaagtggagctcttatcccggaagctaaacagtggagataatctgatagtggaggaagcagtgcaggagctgaactctttcctcgcacaggagaatatgaggctacaggaattgacagatcttcttcaggaaaagcatcgcaccatgtctcaggagttctccaagttgcagagtaaagtggagacagccgaatcacgagtgtctgtcctggagtccatgattgatgacctgcagtgggatattgacaaaattcgaaagagggaacagcgactcaaccgacacttagcagaagtcctagaacgggtgaattccaaaggttataaggtgtatggagcggggagcagtctgtatggcggcacaatcactatcaatgctcggaagtttgaggaaatgaatgcagagcttgaggagaacaaagagttggctcagaaccgtctctgtgagctggagaaacttcggcaagactttgaggaggtcactacacaaaatgaaaagctgaaggtggaattgcggagtgcagtggagcaagtcgttaaggaaactccagaatatcgctgcatgcagtcacagttctccgtcttgtataatgagagcctacagttgaaagcacacttggatgaggctcggaccctgcttcatggcaccagaggaacccaccagcaccaggttgagcttattgagcgagatgaggttagtcttcataagaagctgaggactgaagtaattcagctagaagatacattggcccaggtccgcaaggagtatgaaatgctgaggatagaatttgagcagacccttgctgccaatgaacaagcaggccctataaacagggagatgcgccacctcatcagtagcctccagaatcacaatcaccagctgaaaggggaggtcctgagatataagcggaaattgagagaagcccagtctgacctgaacaagacacgcctgcgtagtggtagtgccctcctgcagtcccagtctagtactgaggacccgaaggatgagcctgcggagctaaaaccagattctgaggacttatcctcccagtcctcagcttcaaaggcatctcaggaggatgccaatgaaatcaagtctaaacgggatgaagaagaacgagaacgagaaaggagggagaaggagagggaacgagaaagagaacgggagaaggagaaggagagagaacgagagaagcagaagctaaaagagtcagaaaaagagagagattctgctaaggataaagagaaaggcaaacatgatgatggacggaaaaaggaagcagaaattatcaaacaattgaagattgaactcaagaaggcacaggagagccaaaaggagatgaaactattgctggatatgtaccgttctgccccaaaggaacagagagacaaagttcagctgatggcagctgagaagaagtctaaggcagagttggaagatctaaggcaaagactcaaggatctggaagataaagagaagaaagagaacaagaaaatggctgatgaggatgccttgaggaagatccgggcagtggaggagcagatagaatacctacagaagaagctagccatggccaagcaggaagaagaagcactcctctctgaaatggatgtcacaggccaggcctttgaagacatgcaggagcaaaatatccgtttgatgcagcaattgcgggagaaggatgatgcaaatttcaagctcatgtcagagcgtatcaagtccaatcagatccataagttgcttaaagaagagaaggaggagctggcagaccaggtgttgactctgaagactcaggttgatgcccagctacaggtagtaaggaaactggaagagaaggagcatctgttacagagcaacattggcacaggggagaaagagctgggtcttaggacccaagccttagagatgaataaacgcaaggcaatggaggcagcccagcttgcagatgacctcaaagcacaactggagttggctcagaagaagctacatgattttcaggatgagatcgtggagaacagtgttaccaaagaaaaggacatgttcaatttcaaacgagcccaggaggacatctctagacttcgcaggaagctggagaccacaaagaaaccagacaatgtacccaagtgtgatgagattctgatggaagagattaaggattacaaggcacgcttgacctgtccgtgctgtaacatgcgtaaaaaggatgctgttcttactaagtgttttcatgtcttctgctttgagtgtgtgaagacacgctatgacacccgccagcgcaaatgtcccaagtgtaatgctgcttttggtgccaatgattttcatcgcatctacattggttgatctaagtcaagagaagaagaggagctggctagtcaggaacttattcattaaccaccaaacctctacctcttctctccttgactgtcacctgtaggacagtttatcagtcaactacctttcctccagactttacttccaggctctcctcttcagtagctggatgactttagcagaaaggactggtaaatacaagccttgggtttcagaatgaattagaaacaaataactcttactgtcttccctcccagctttgtttattttgtgcttttagacttttcagtgttttctttttccagcccactgtataaacttggattgtccattcctcctgaagaaatcaagttggtatttttgatgtggaaaagggaacaaaagtggaaacatggctacttttggggagtgatattttaaaaaataagttgtctatgggcacaaagttttcttcatttgtgtagcaaacttcttgtgaatgtggattacaaaatggtataattgtgctactctcccctgggtggtttgcagccctaatgaaattatgtctaggatgattcagtctatttcccatttactagcagagtaacttgttaagatcagctggctttcttgttaaagttatttaagttttgaatgctctactacttcaagtctttaaatttcttgagactagaataattttaaataatatgaccctttgtcttctaatgaaataaagattgaagaggttgagtcaggactgagctggtgaagaaatcttgtgggtattctggaaatttgatacggagagaacttggtgagctatgaattactctcagtctcctttttacagggttgttgtgatccctcttttccagaaaattctgtggaatgtttctgtaggactttgttctccacaagcttgaattaaagcaggattcagtttgca

SEQ ID NO: 177384 - DNA, 784 bp, Homo sapiens
  Payload ID: 14808
  Gene Symbol: RNF20
  Gene Name: ring finger protein 20, E3 ubiquitin protein ligase
  ENST ID: ENST00000466817
  CDS Start-End: 349-784
gcttagggcccaacaggactgtgccaggcctcaggagtctccaccctctccagttttggggccgtcagtctcctgggcctgcaattatccacgctgaggctgaggtctttggcttttagcgagttggattgcagccttgttctgcttctgtgtcttctctctccaggcgaggtcctactgaggttgttgccagcgatagtcctctcctggagcttgaattggaagcagagtagtcttgttagtctcggtgatggctgcgttgtttcctgaagtagccaaagtgctttagcatccattccgcctcctttgagcaccctgggaggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcagtttgatgaaaacatccgtatcatccttaaacgttatgatctggagcagggcttgggagacctactcacagaacgaaaagcccttgttgtgcctgaaccagaaccagactctgatagcaatcaggagcgtaaagatgacc

SEQ ID NO: 177385 - DNA, 387 bp, Homo sapiens
  Payload ID: 14808
  Gene Symbol: RNF20
  Gene Name: ring finger protein 20, E3 ubiquitin protein ligase
  ENST ID: ENST00000479306
  CDS Start-End: 91-387
acgggccttggtgagtaactgctgcgagttctgttcccgcgcggcgccagttcaaagaacttaggaaaacgactgtcttcttctgccaaaatgtcaggaattggaaataaaagagcagctggagaacctggcacctccatgcctcctgagaagaaggcagctgttgaagattcagggaccacagtggaaacaattaagctaggaggtgtctcttcaacggaggaactagacattagaacactgcaaaccaaaaatcgcaagctggcagaaatgttggatcagcggcaggccattgaagatgaacttcgtgagcacattgaaaaactggaacgacgacaggccactgatgatgcctcactattgattgtcaaccgatactggagtcag

SEQ ID NO: 177386 - DNA, 3924 bp, Homo sapiens
  Payload ID: 14809
  Gene Symbol: RNF207
  Gene Name: ring finger protein 207
  Uniprot ID: Q6ZRF8
  ENST ID: ENST00000377939
  CDS Start-End: 128-2032
ggccggctactcctcggcagagcgaccgcgcggtgtctcagagcgcggcccggagccgcactaagagcgctggacggcgggagagaggctcggaggaccggtagctcccagcaaagcggcccagcggatgtcgggagctatcttcgggcccctggagggcccgagctccctggatgccccgagcatccacccgctggtgtgcccgctgtgccacgtgcagtacgagcgcccgtgtcttctggactgtttccacgacttctgtgccggctgcctgcgtggccgcgcgaccgacggccgcctcacctgcccgctgtgccaacaccagacggtgctgaagggtcccagcgggctcccgccggtggaccggctgctgcagttcctggtggacagctcaggggatggcgtggaggcggtgcgctgtgccaactgtgacctggagtgcagcgagcaggacgtggagaccacgtacttctgcaacacgtgcggacagcccctatgcgcgcgctgccgcgacgagacgcaccgagcacgcatgttcgcgcgccacgacatcgtggccctgggtcagcgaagccgcgacgtgccccagaagtgcacgctgcacgcagagccctacctcttgttctccaccgacaagaagttgctgttgtgcatccgctgcttccgcgacatgcagaaggagagccgggcacactgcgtggacctggaatcggcttacgtgcagggctgcgagcggctggagcaggcggtgctggccgtgaaggccctgcagacggccacgcgggaggccatcgcgctgctgcaggccatggtggaggaggtgcggcacagcgccgccgaggaggaggacgctatccacgccctcttcggcagcatgcaggacaggctggcagagaggaaagcgctgctgctgcaggctgtgcagagccaatacgaagagaaggacaaggccttcaaggagcagctctctcacttggccaccttgctgcccaccctgcaggtccacctggtcatctgctcctccttcctcagcttggccaacaaggctgagttcctggacctgggctatgagctgatggagaggctgcagggcatcgtcacgcggccgcaccacctaaggcctattcagagcagcaagattgccagtgaccaccgagctgaattcgcgcgctgtctggagccactgctgctgctggggccacgtcgggtggcagctgctgcaagtggtgctaacacgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagatttgggaggaagcctatcagcgagtggctaatgagcaggagatttatgaagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatcatcacagatccaaacagaaaaatgggggcgatgtccccacatggagggaacacccgacttagcaaatgggaccggtccccagggtcaggctcttagagcaggcacaagactgggacactggacagaaggttgttcccatgatggttttttttattttttatttttgagatggagtttcgctctgttgcccaggctggagtgtaatggtgcaatctcggctcactgcaacctctgcctcctgggttcaagcgattctcctgcctcagcctcccgagtagctgggattacaggcgcctgacaccacgccccgctaattttttgtatttttagtagagatggggtttcaccatgttggccaggctggtctcaaacgccagacctcaggtgatccacctgcctcagcctcccaaagtgctgagattacaggggtgagtcaccgcgcctggccaatgttgttgttgtttttaagacagaatttcactctttgttgcccaggctggagtgcaatggcgcaatctctggctcaccgcaacctccgcctcccaggttcaagcgattctcctacctcagcccccagagtagctgggattacaggcatgtaccatcacacccggctaattttttgtattttaagtagagagggggtttctccatgttggtcaggctggcctcgaactcccaacctcaggtgatccgcccacctcggcctcccaaaatgctgggattacaggggtaagccactgtgcccggccggttatttctttaaaaggtaatcatttgtcaagagtaaaacccagaagctctgacaggccataatttcagatcctttggcttgggcagttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgatagcaaggcactgggtggcagcaaccttttttctagtagttttttcccagcagttttccatttctccacagtatccttttcatttagaggagcttaataaatgctttttaaaaagtaacccacgtgacgtaaaattttacaagtttttgtggcaaaatgatgcccagatagtcacatttaagcaaatattcagcttgattcagtgattaacagcaaatgggtctacgtgctaacatggcagcacattcaacacataacacatcactcacattgacgtccactgtccctgcacctgctacttcaggggcactgaggctcctgttccaaggccttacaaacctatgtggtggcctgcagggcaaaaggaattatcattacaactggttagaggtaggaattcagaaagaaattgaggaggccaaacacacgtcgtttgaggctaaaggcttaagacgcttcttacccaagagtgacctcagagtttcacatcccagacaatcacactgtggttgagtgaaatcaagtgcagttttatttaagaactggaaagaataatcagtatctgtgaaagaaaatccaatttagaatatttaaataaacatttatgtaaaaagaa

SEQ ID NO: 177387 - DNA, 1077 bp, Homo sapiens
  Payload ID: 14810
  Gene Symbol: RNF208
  Gene Name: ring finger protein 208
  Uniprot ID: Q9H0X6
  ENST ID: ENST00000391553
  CDS Start-End: 112-897
cggggccccccccaggcctggcgggaccaggatgctgccctgtcacctgccccccagccccacacaacgcccccacccacccgaacatccagtctgactggagacagccggatgccctctgaccccgggcccgaggcgggcagtggctggccgggcctcctcatgtcctgcctgaagggtccccatgtcatcctcaagatggaggccatgaagattgtccaccctgaaaagttccctgagctaccggctgccccctgcttcccgcctgctccccggcccaccccaactctggcacccaagcgtgcctggccctcagacacagagatcattgtcaaccaggcctgtgggggggacatgcctgccttggaaggggcaccccataccccgccactgccacggcggccccgtaagggaagctcggagctgggctttccccgcgtggccccagaggatgaggtcattgtgaatcagtacgtgattcggcctggcccctcggcctcggcggcttcttcggcggcggcaggcgagcccctggagtgccccacctgtgggcactcctacaatgtcacccagcggaggccccgcgtgctgtcctgcctgcactctgtgtgtgagcagtgcctgcagattctctacgagtcctgccccaagtacaagttcatctcctgccccacctgccgccgtgagactgtgctcttcaccgactacggcctggccgcgctggctgtcaacacgtccatcctgagccgcctgccgcctgaggcgctgacggccccatccgggggtcagtggggggctgagcccgagggcagctgctaccagaccttccggcagtactgtggggccgcgtgcacctgccacgtgcggaacccactgtccgcctgctccatcatgtagtagcgcctgcctgcccgccactgcccgctgagcctcgctcgctgcttcttcagggacccggccctgccctgccgcccgctgacccttccttccccaccatggcttccggccccaccccgagtggcattgtcgctgcagccaactttgccattaaaactctttgccaaagtttgcacctgt

SEQ ID NO: 177388 - DNA, 1135 bp, Homo sapiens
  Payload ID: 14810
  Gene Symbol: RNF208
  Gene Name: ring finger protein 208
  Uniprot ID: Q9H0X6
  ENST ID: ENST00000392827
  CDS Start-End: 170-955
ggcctgctgacctcggctgcagggggagccccccccgcgccccctcgccagcctcagcagccagagaccctgggcctggcgggaccaggatgctgccctgtcacctgccccccagccccacacaacgcccccacccacccgaacatccagtctgactggagacagccggatgccctctgaccccgggcccgaggcgggcagtggctggccgggcctcctcatgtcctgcctgaagggtccccatgtcatcctcaagatggaggccatgaagattgtccaccctgaaaagttccctgagctaccggctgccccctgcttcccgcctgctccccggcccaccccaactctggcacccaagcgtgcctggccctcagacacagagatcattgtcaaccaggcctgtgggggggacatgcctgccttggaaggggcaccccataccccgccactgccacggcggccccgtaagggaagctcggagctgggctttccccgcgtggccccagaggatgaggtcattgtgaatcagtacgtgattcggcctggcccctcggcctcggcggcttcttcggcggcggcaggcgagcccctggagtgccccacctgtgggcactcctacaatgtcacccagcggaggccccgcgtgctgtcctgcctgcactctgtgtgtgagcagtgcctgcagattctctacgagtcctgccccaagtacaagttcatctcctgccccacctgccgccgtgagactgtgctcttcaccgactacggcctggccgcgctggctgtcaacacgtccatcctgagccgcctgccgcctgaggcgctgacggccccatccgggggtcagtggggggctgagcccgagggcagctgctaccagaccttccggcagtactgtggggccgcgtgcacctgccacgtgcggaacccactgtccgcctgctccatcatgtagtagcgcctgcctgcccgccactgcccgctgagcctcgctcgctgcttcttcagggacccggccctgccctgccgcccgctgacccttccttccccaccatggcttccggccccaccccgagtggcattgtcgctgcagccaactttgccattaaaactctttgccaaagtttgcacctgt

SEQ ID NO: 177389 - DNA, 1019 bp, Homo sapiens
  Payload ID: 14811
  Gene Symbol: RNF212
  Gene Name: ring finger protein 212
  Uniprot ID: Q495C1
  ENST ID: ENST00000333673
  CDS Start-End: 67-888
ggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagtatctcaggctttcccgaggctgttgccgtctcaagttatgcccagccacatcctccaaggaggtgcccagaggctcgacccatggaagccaagcagcagccagagatccccaagaacactgggtcagcacaacacgggcacccagaccaggatgccggcggtcccagagccagccagaggcccagggaaacaccatccaggacgcacctcaccccctcaccctgctccatcccagcaggaccctcattcacaccaagtccccttggggccagaagttgcttgagttcataaaacatgtctgttatcacagacatcagagccacaggccgtgcgctccagggtggttttgccaagtgctgcagaggccaggtgctgtctcaggagagaagacccagcagacccggccagcccctccagccacctgtctgctctgcctctcgtgcctctcaggcttccggcatgggccgtggaggtcacaggctctgcccagtgacctcgtggccccactgtttgtcagttacactgtggaggtgagcatcacaaacgcagggtggagttttcccgcagctgtgtgacgtgaggtggtattgtaacatttatgctctaatatcaacgtaacataaatattggcatttgttacaatatgttaacacatcatggatttattgttatttttaaatgaattaataaatacttttagatttgt

SEQ ID NO: 177390 - DNA, 2335 bp, Homo sapiens
  Payload ID: 14811
  Gene Symbol: RNF212
  Gene Name: ring finger protein 212
  Uniprot ID: Q495C1
  ENST ID: ENST00000382968
  CDS Start-End: 99-797
agagctgcccgccttcgggccctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaatgattctgagtgttttcaatttattcctctgtgttttttctacaaattatctgctttattcctttgtcatttatgtggaagccctcagtgtgcaggatattaaccttttacccaatttgctttgtaattttatatttgacctttgaattttagagacaatatttttatgtactcatatatattgttattatcccttttattttataggttctcatgcttagggagtttttttttcacatacttaaatcatttttttctaactgggtggtttttaaaactttttcttagagcagttttaggttcacagaaaaattgaaaggaaggtacagatttcccatatacaccatgactccacacacgcacagctcccccatcatcctcatcctccaccagagcagtccatgtgttaaaactgatgatcctacttgaatacatcattatcacccaacgtccatggtttacattagggttcactctaggtgtcgaatgttctatgggtttgaacaaatatctagtgacatgtgtccccatcgtagcagcatatggaatagtgccacaccctaaaaatcctctgtgcgccacctgttcatccttcccccacctcccaccaacccttgacagccactgatctttttacggtccctttttcagactctcctggagttggaattgtacagtatgtggcttctcagattgactcctttcacttagcaatacacacttatggttcccccatctcttctcatggtttgctagctcattttttcagtcactgaataatattccattatctggatgtatcatagttcatccattcacctactgaagggcatcttggttgcttccaagttttggcaattatgaattaagctgctatagatgtccatgtgccagggttttgtgtagacatgttttcagctcctttgggtaaatactaaggagtgtgaatgctggatcagatggtgagagggtgtttagttttgaaagaaattgccaaactaccttccaaagtggcagcagcttttcgcattcccactagcaacgaatgagagttcctgttgctccacgtcctcacatttgatgatgtcagtgttctggattttggccagctgataggtatgtagtggtatcttgctgttttattttgcatttcattgataacatatgactaggagcatcttatgctgatttttcatctgcatatcttctttgctgaagtgtctgttaaggtatttggcccattttttaattggattgttttcttattgttgagttttaagagtcctgtgtatattttggatgacatttcttttttgtgtgtcttttttttggatgacatttccttatcagataaatatgtatcttgaaaatata

SEQ ID NO: 177391 - DNA, 1074 bp, Homo sapiens
  Payload ID: 14811
  Gene Symbol: RNF212
  Gene Name: ring finger protein 212
  Uniprot ID: Q495C1
  ENST ID: ENST00000433731
  CDS Start-End: 63-956
ggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggggccacatctaacagcttctttctgtttcatcccatggttgaccttgtctaagccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaatgattctgagtgttttcaatttattcctctgtgttttttctacaaattatctgctttattcctttgtcatttatgtggaagccctcagtgtgcagg

SEQ ID NO: 177392 - DNA, 804 bp, Homo sapiens
  Payload ID: 14811
  Gene Symbol: RNF212
  Gene Name: ring finger protein 212
  ENST ID: ENST00000508428
  CDS Start-End: 52-210
tgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaagaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaaactggagtcgatggaagttgatctctctccttctccgattagaaaatctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaat

SEQ ID NO: 177393 - DNA, 934 bp, Homo sapiens
  Payload ID: 14811
  Gene Symbol: RNF212
  Gene Name: ring finger protein 212
  ENST ID: ENST00000510715
  CDS Start-End: 78-425
ctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcatcgcccctttcctgtgtctgacagcgagtcaccaacagcacgcctttacagctgcgtgaggagagccccgtggatcccgcacaggggtacccgtgtccgcttgcgccgtcggaccttgtggactcgattgctctgcaccagggttgatttcctccattccttacgccctctgccatgatgacgtcagacgcagcaaaggccttcagtcacgctaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtg

SEQ ID NO: 177394 - DNA, 753 bp, Homo sapiens
  Payload ID: 14811
  Gene Symbol: RNF212
  Gene Name: ring finger protein 212
  ENST ID: ENST00000506730
  CDS Start-End: 77-235
tgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaagaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatgggcagcgtctcctccctgggccccgagcatcccggcctgacaacgagtcagaggagcatgggaaagcctctcaggattccacctctgcaaattccctacaagggacccccactaacgccaacaccacagttaccagggagagcaggaagaggggactctccaagct

SEQ ID NO: 177395 - DNA, 926 bp, Homo sapiens
  Payload ID: 14811
  Gene Symbol: RNF212
  Gene Name: ring finger protein 212
  Uniprot ID: Q495C1
  ENST ID: ENST00000511620
  CDS Start-End: 63-434
ggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtctgagatagcagccggccctgcgagaatctccatgattagtccacctcaagatggacgaatggggccacatctaacagcttctttctgtttcatcccatggttgaccttgtctaagccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttgatttgcatttatgtgactattaatgattctgagtgttttcaatttattcctctgtgttttttctacaaattatctgctttattcctttgtcatttatgtggaagccctcagtgtgcagg

SEQ ID NO: 177396 - DNA, 1071 bp, Homo sapiens
  Payload ID: 14812
  Gene Symbol: RNF212B
  Gene Name: ring finger protein 212B
  ENST ID: ENST00000399905
  CDS Start-End: 143-394
ttgccagaagtgaagggaaaggagttatgggagagtatgtcaaaggcttgtttttccctagtaggtgtggagtttccagaagaaacaaacagatctcctcatcgccttttataagcatagaattacaaagttagaaacagccatgcaggaggcacagcaagcactggtgagccaggacaatcggtcctcctcagcggaatctattccttatagagaggctggctttggtagcttgggacaaaaaccccttcaccggcttcaactcatagcctatcttataggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatgtatccctgcattgtttcctagtttcactctgtaccttatgctccccccatctttaccctattcacccttatcacctcccaggacagtggtcaggtcttacaaaaggctagtgcttcaggaagatgtttatatctcttccagaagacactggtagctcccctcatttcctacaatttggaacaaaggtcaaaaaaataattcttggcatcatgcttggttgggagttgggaatggggattgtgatggatcatatactcatcactgtttcatttctggatttcatttttagctttggatatactgtcccattgccaatgttaacgagcaatatctctgttcttttccttattatacttttttatttgtctattatttcctctatgcttagttactattaaatgttaattttcctttctattgaaaacaactgttggagacactgattttcagcttagtatatagatagtaaaataaagacgatgcccttttattgctacaa

SEQ ID NO: 177397 - DNA, 1670 bp, Homo sapiens
  Payload ID: 14812
  Gene Symbol: RNF212B
  Gene Name: ring finger protein 212B
  Uniprot ID: A8MTL3
  ENST ID: ENST00000399910
  CDS Start-End: 254-1156
ggaatgagtcatgggaaatgaaaaaatgtcgaatttgcctctagcctttcctgacaaccttagaaagcactgaggaaaaatttgatagattcatttgtatacattcagatttgaagacttctgctccgatttcaacatcaccatataaaacaaataatgtttctgcttcttaaacaaagctgttggagaatgtgcaccaccaaaataagggaataagtaaaggaggaagaagaccctgagttcaggaataagaatggattggtttcattgcaaccagtgcttccgaaaagatggggcccatttctttgtcaccagctgtggccatattttctgtaaaaagtgtgtgactctggaaaaatgtgctgtttgtggaactgcctgcaagcatctggctctttctgataatctgaagcctcaggagaagatgtttttcaaaagtcctgtggagacagctttgcagtattttagtcacatctctcaggtgtggagtttccagaagaaacaaacagatctcctcatcgccttttataagcatagaattacaaagttagaaacagccatgcaggaggcacagcaagcactggtgagccaggacaaagaattgtcagtcttaaggaaggagaatggagaactgaagaaatttctagccattctaaaggaatctccaagtcggtaccaaggaagcaggtcaatcacacctcgaccagtgggcattacttccccatcacagtcagttaccccacgacccagtttccagcatagcagtcaagtggtcagtcggtcctcctcagcggaatctattccttatagagaggctggctttggtagcttgggacaaggaggcagaggtctgcagggaaggagaactcccagagactcttataatgaaaccccttcaccggcttcaactcatagcctatcttatagaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatagatcatcttcaagatctgatctatacatgctgctgaaggatggactgtagcttccagtacgcattaggggtgatggccctggaaaatgtatccctgcattgtttcctagtttcactctgtaccttatgctccccccatctttaccctattcacccttatcacctcccaggacagtggtcaggtcttacaaaaggctagtgcttcaggaagatgtttatatctcttccagaagacactggtagctcccctcatttcctacaatttggaacaaaggtcaaaaaaataattcttggcatcatgcttggttgggagttgggaatggggattgtgatggatcatatactcatcactgtttcatttctggatttcatttttagctttggatatactgtcccattgccaatgttaacgagcaatatctctgttcttttccttattatacttttttatttgtctattatttcctctatgcttagttactattaaatgttaattttcctttctattgaaaacaa

SEQ ID NO: 177398 - DNA, 903 bp, Homo sapiens
  Payload ID: 14812
  Gene Symbol: RNF212B
  Gene Name: ring finger protein 212B
  Uniprot ID: A8MTL3
  ENST ID: ENST00000430154
  CDS Start-End: 1-903
atggattggtttcattgcaaccagtgcttccgaaaagatggggcccatttctttgtcaccagctgtggccatattttctgtaaaaagtgtgtgactctggaaaaatgtgctgtttgtggaactgcctgcaagcatctggctctttctgataatctgaagcctcaggagaagatgtttttcaaaagtcctgtggagacagctttgcagtattttagtcacatctctcaggtgtggagtttccagaagaaacaaacagatctcctcatcgccttttataagcatagaattacaaagttagaaacagccatgcaggaggcacagcaagcactggtgagccaggacaaagaattgtcagtcttaaggaaggagaatggagaactgaagaaatttctagccattctaaaggaatctccaagtcggtaccaaggaagcaggtcaatcacacctcgaccagtgggcattacttccccatcacagtcagttaccccacgacccagtttccagcatagcagtcaagtggtcagtcggtcctcctcagcggaatctattccttatagagaggctggctttggtagcttgggacaaggaggcagaggtctgcagggaaggagaactcccagagactcttataatgaaaccccttcaccggcttcaactcatagcctatcttatagaacttcatctgcctcctctggacaggggattttttctttcagaccatccccaaatgggcattcaggccacacaagagtcctcacccccaacaattttgctcagagggagagcacaactacactagagagtcttcctagtttccagctaccagtcctgcagactctctaccaacaacggaggcatatgggattacccagtgggagagaagcatggaccacttctagatag

SEQ ID NO: 177399 - DNA, 484 bp, Homo sapiens
  Payload ID: 14812
  Gene Symbol: RNF212B
  Gene Name: ring finger protein 212B
  ENST ID: ENST00000492621
  CDS Start-End: 234-484
aaaaaatgtcgaatttgcctctagcctttcctgacaaccttagaaagcactgaggaaaaatttgatagattcatttgtatacattcagatttgaagacttctgctccgatttcaacatcaccatataaaacaaataatgtttctgcttcttaaacaaagctgttggagaatgtgcaccaccaaaataagggaataagtaaaggaggaagaagaccctgagttcaggaataagaatggattggtttcattgcaaccagtgcttccgaaaagatggggcccatttctttgtcaccagctgtggccatattttctgtaaaaagtgtgtgactctggaaaaatgtgctgtttgtggaactgcctgcaagcatctggctctttctgataatctgaagcctcaggagaagatgtttttcaaaagtcctgtggagacagctttgcagtattttagtcacatctctcagactctctaccaacaacggaggca

SEQ ID NO: 177400 - DNA, 226 bp, Homo sapiens
  Payload ID: 14812
  Gene Symbol: RNF212B
  Gene Name: ring finger protein 212B
  ENST ID: ENST00000470456
  CDS Start-End: 1-226
gtgtggagtttccagaagaaacaaacagatctcctcatcgccttttataagcatagaattacaaagttagaaacagccatgcaggaggcacagcaagcactggtgagccaggacaatcggtcctcctcagcggaatctattccttatagagaggctggctttggtagcttgggacaaggaggcagaggtctgcagggaaggagaactcccagagactcttataatg

SEQ ID NO: 177401 - DNA, 5316 bp, Homo sapiens
  Payload ID: 14813
  Gene Symbol: RNF213
  Gene Name: ring finger protein 213
  Uniprot ID: Q63HN8
  ENST ID: ENST00000319921
  CDS Start-End: 142-3333
gcgcgcggcaggcggcgagctcgggggccgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaagcaaaaagaagaaaaggaagaagaaaaagaaggggaacaagtccgcttcctcagagctggcttccttgcccctttctcctgccagcccctgtcacctgactttgctttcaaacccgtggcctcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctagttctctccggattcctcagtgtgctgcacagtccctgctgctcgcaccatcctgcatgtgttccatatggaatcacggccgtgcgcgtgtggcacaagtcacacgggcttgcaggccgttcctcagatggccctgtcatcactgtggctgctggtttgattgattgttaacacttgctcagtaggtgtgcgggaagagactccaaaggttgacagaacatttatggaagcaaaatatgtgaaatggaaaattgtatcaatttatttagctcttttcggcaaaggggaagagattgtgcccccctgtctcccaggaacagtctcgcaggcaatgccacatgaggaagctccctgctggccacggctgccctgctcacatttcctaattggacacttaacccctgtacaagcacagccttgcggccacaggggaagtccagaaacattgaggtcattgaattccggggaccaaggggttctaattttttaagtgactgatacctttgataaggttttcctttccctttttcgttaactctttgttgagatattgttcgtatgccatacggtacatctgtcaaaagttccagttcagcaggttttggggtagtcacagatatgtacagtcatcaccacagttaatgacagagcattttcatcacttcaaagagaaacccggcccctttagccatcatcctcctcccctctagtcacccactcccctctgcaggcataaacaattgctgaacataaacaactgcttctgtggctttctctgttctgactgtcatatgaatggaatcatatcatatgtggccttttgggtatggcttatttcactgagcataatgtttttttgttgttggtggtggtggttgtttgttgtttttgagacagagtttcactctttttgcccaggctggagtgcaatggtgcgatcctggctcaccgcaaccgctgcctcccgggttcaagtgattctcctgcctcagcctcccaagtgctggaattacagctactttttgtttaaagagtcttttaattgtttaaagaacaatgtgccgccacactcggttccttttgtatttttagaagagacagggtttctccatgttggtcaggctggtctcgaactcccgacctcaggtgatccacccaccttggcctcccgaagtgccgagattacaggtgtgagccaccgcgcccggccgagcataatgttttgaaagaccgctcaggctggacacggttgctcacgcctgtaatcacggcactttgggagcccaggagttcaagacaagcctgggtaacagagtaagaccctgtctctataaaaactaaaaaataaacaaaaaaaattagccaggcatggccgggcacacctgtggtcccagctacttgggaggctgaggtgggaggctcccttgggcccagaaggtcaaggcagcagtgagccatgatcacaccactgcacttcaacctgggggacagagcaagaccctgtctcaaaaagcaataacaacaaaagtccatccatattgtagcttgtgtccgtttacgttaagtattccttacccaaaatgcttgagaccagaagtgttttggatttcagatgttttcaaattttggaatatttgcatttacataatgagatgtcttccagatgggacccagagtctaaccacaaaattcacttgtttcatatacatcttatacacatagcctgaaggtaattttatacaatatttttaacaattttgtgcatgagacaaagtttgtattaagtatttgtatgttgaatttttcacttgtggcatcattatactcaaaaagtttggattttgtagtattttggatttggggattaggaatgctcaacctatatttcatttttttccatggccaaatattccccgtttatccatgtgtccattgacggccatctatgttgcttcttcggctattataaatctgctgatacaaa

SEQ ID NO: 177402 - DNA, 17730 bp, Homo sapiens
  Payload ID: 14813
  Gene Symbol: RNF213
  Gene Name: ring finger protein 213
  ENST ID: ENST00000508628
  CDS Start-End: 146-15916
gacagcgcgcggcaggcggcgagctcgggggccgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaggagctacatcagaggttttggtagatgctgctgtagacctcatatccgatgaatgggaagctgctaatgccatacccagcaagagaaggaagcaggatgcagccccgcttgaggccgccagcgtgccttctgcagactgtgagcagagcaaaaagaagaaaaggaagaagaaaaagaaggggaacaagtccgcttcctcagagctggcttccttgcccctttctcctgccagcccctgtcacctgactttgctttcaaacccgtggcctcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcgatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccgtgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttgaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactgtgtgactccgccaggaacttggaatggctgaagactgtgaatgagagtcatgggtctgtggaacgctcatccctgaccctggccacggccatcaaccaaagaggcatctatgtgatccaggcgcccaaaggtggccaaaagatttccccagacacggttctgcacttgatccttcctgagagccctggcagccacgaggagtcacgagagtactctttagaggaggtgaaggagcttttgaacaagttgatgctgatgtctggcaagaaggatcgtaacaacacggaagtggagaggttttcagaggtcttctgcagtgtgcagaggctcagccaggccttcatcgacctgcactctgctgggaatatgctgttcaggacgtggatcgccatggcctactgctcccccaagcagggtgtgtccctccaaatggactttggcttggacctggtgacggagcttaaagaaggtggagatgtcactgagctgctggcagccctctgcaggcagatggagcacttccttgacagctggaagagatttgtgacccagaagcgaatggagcacttttacctgaacttctacacggcagagcagctggtttacctgagcactgagctcaggaagcagcccccgagtgatgccgccctaacgatgctatccttcatcaaaagcaactgcaccctgagggatgtcttaagggcctctgtggggtgtgggagtgaggccgccaggtaccgcatgaggagagtcatggaagagctcccgctgatgctcttatcagagttcagcctggtggacaagctgaggatcatcatggagcagtccatgaggtgccttcctgccttcctgcccgactgcctcgacctagagacccttggccactgtctggctcacctggcagggatgggtgggtctcccgtggagcgttgtctcccgagaggtctgcaggtcggccagcccaacctcgtcgtctgtggccactccgaggtgttgccagccgccctggctgtctacatgcaaaccccaagccagcccctgcccacttacgatgaggtgctgctctgcaccccggcaaccacctttgaggaggtggcactgttgctgcgccgctgcctgaccctgggctccctggggcacaaggtctacagcctgctgttcgcagatcagctgagctacgaggtggcacgccaagcggaggagcttttccacaatctgtgcacgcagcagcaccgagaagactaccagctcgtcatggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcggcggcagccgtgttcaatgaccggctgtgtgttgggatcgtggcctcggagcgagcaggtgttggaaagtctctgtacgtgaagaggttgcacgacaaaatgaagatgcagttaaacgtgaaaaatgtgcctctgaaaacaattcgactgatcgaccctcaggtggatgagagccgagtcctgggcgccctgctgcccttcctggatgcgcagtatcagaaggtccccgtgctctttcacctggacgtgacctcctcagtgcagactggaatttgggtgtttcttttcaagctcctcattttacaatacttaatggatataaatgggaaaatgtggcttcggaacccctgccatttgtatatcgttgaaatcctggaaaggaggacgtcagtgccgtcgaggagctcttcagcgctgcgtacacgtgtaccccagttcagttttcttgacatcttcccaaaagtcacctgcaggcctcccaaagaggtgatagacatggagctgagtgccctgaggagtgacacagagcctgggatggatctgtgggagttctgcagcgaaactttccaaagaccttaccagtatttaagacgattcaatcaaaaccaagacctagacacgtttcagtatcaagaaggctctgtcgaaggcaccccggaggaatgcctccagcatttcctgtttcactgcggggtaataaacccatcctggtcagagcttcggaactttgctcggttcctgaattatcagctcagagattgtgaggcctctctcttctgcaatccgagttttattggcgacacactgaggggcttcaagaagttcgtggtgaccttcatgatctttatggcaagagattttgccacaccatcactccacacctctgaccaaagcccggggaagcacatggtcaccatggatggggttagggaagaagatctagcgcccttctccctccggaagaggtgggagtcggagcctcacccatacgttttcttcaatgacgaccacacaaccatgacattcatcggcttccatctgcagcccaacatcaacggcagtgtcgatgccatcagtcacttgactgggaaggtcatcaagagagacgtcatgaccagggacctgtaccagggcctgctgctccagagggtgcccttcaatgtcgactttgataaactgcccagacacaagaaacttgagaggctctgcctgaccttagggatcccccaggccaccgaccccgacaaaacgtatgagctcacaaccgacaatatgcttaaaatccttgccatcgagatgcggttccggtgtgggatcccggttatcatcatgggagaaactggctgtgggaaaaccaggcttattaaattccttagcgacctgcggcgtggtggtaccaatgctgacaccataaagctggtcaaggtgcacggaggaacaactgcagacatgatctactccagagtcagggaggctgaaaatgtggccttcgccaataaggaccaacatcagttggacaccatcttgttttttgatgaagccaacacaacggaagctataagctgtatcaaagaagtcctgtgtgatcatatggtggatggccagcctctggctgaggactctggcctgcatattatagctgcctgcaatccataccggaagcactctgaggagatgatctgccgtttggagtcagctggtttgggctacagggttagtatggaggagacggccgacaggctgggctccattcctctgaggcagctggtataccgggtccatgctctgcccccgagcctgattcctctggtgtgggactttggacaactgagtgacgttgctgaaaagctctacatccagcagattgtccagagactggttgagtccatcagcctagatgaaaacgggactcgcgtgatcacagaagtcctctgcgcctctcagggtttcatgaggaaaacagaagatgagtgcagctttgtcagcctcagggacgtggagcgctgtgtgaaagttttcaggtggttccacgagcacagcgcgatgctcttagcgcagctgaatgcctttctctccaagtccagcgtcagcaaaaatcacaccgagagagatcccgtcctctggtcgttgatgctggccatcggggtgtgttaccatgcctctttagaaaagaaagactcatatcggaaagccatcgccaggttctttccgaaaccgtatgacgacagcaggctgcttctggatgaaataacacgggcacaggatctttttctggacggcgtacctctgaggaaaaccatcgccaagaacttggccttgaaggagaacgtcttcatgatggtcgtctgcatcgagctgaagattcccctcttcctggtggggaagcccggcagctccaagtctctcgccaagaccatcgtggcagacgccatgcagggcccggctgcctactcagatctcttccgcagcctgaagcaggtccacctggtgtccttccagtgcagcccgcactccaccccacagggcatcatcagcaccttccggcagtgcgcccgctttcagcaggggaaggacctgcagcagtacgtctctgtggtggtgttagatgaggtggggctggcggaagactcacccaaaatgcccctgaagactctgcacccgctgctggaagacggatgcattgaagacgatcccgccccccacaaaaaggtcggcttcgtgggcatctccaactgggcccttgaccctgccaagatgaaccggggcatttttgtgtcacgtggcagccccaacgagacagagctcatagagagcgccaagggcatctgctcctcagacatcctcgtccaggaccgagtccaagggtactttgcgtcctttgccaaagcctacgaaacggtgtgtaagcgccaggacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagtgctcagaggaagtcagccccatgcagctgatcaaacagaacatctttgggccttctcagaaggtgccgggtggagagcaggaagatgctgagtcccgctacttactcgtgctgaccaaaaactacgtggcactgcagatcctgcagcagacattcttcgagggggaccagcagccggagattatttttggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcggccagaagtacgtggacctcggtctggggacccaccgcgtcaaatgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttcaccagaaggtgtctgaggaggccaaatcgatcctgctgaactgcgctacgcccgatgccgtggtccggctgagcgcctactcgctgggcgggttcgcagcggagtggctgtcgcaggagtactttcacagacagaggcacaactcctttgcagatttccttcaggcacacctgcacacggcagacctggagcgccacgccatcttcacagagatcaccactttctccaggctgctaacaagtcacgactgtgaaattttagaatcagaggtcacaggcagggctccgaaacccacactcctgtggctgcagcagtttgacaccgagtactcattcctcaaagaagtccgaaactgtttaacgaatacagccaaatgtaaaatcctcatttttcagacagattttgaagatggaatccgtagcgcccagctcattgcctcagctaagtattctgttataaatgaaatcaacaaaatacgagaaaatgaggaccgtatcttcgtctatttcatcacaaaactgtcccgggtgggaagaggaacagcctatgtgggcttccacggagggctgtggcagtctgtccacatcgatgacctccggagatccaccctcatggtttctgatgtgaccaggctgcagcatgtcaccatcagccagctgttcgcgcccggagacttgcctgagctgggcttggaacaccgggcggaagacggccatgaggaggcgatggagacggaggccagcacatcaggggaggtggcagaggtggcagaggaggccatggaaacagaaagttctgagaaggtgggaaaggaaacctctgaactcggaggcagtgatgtgtcgatcctggacaccaccaggctgctgagaagctgtgtgcagagcgccgtgggcatgctcagagaccagaacgagagctgcacgcgcaatatgcggagggtggtgctcctcctgggcctcttgaatgaggatgacgcgtgccacgcctctttcttgcgggtatccaagatgcgcctcagtgtctttttaaagaagcaagaagagagccagtttcaccctctggagtggttggcaagggaagcctgcaaccaggacgctctccaggaggcgggcacattcaggcacaccctctggaagcgggtccaaggtgctgtcacccctctgctggcgagcatgatatcattcatcgacagagacggcaacctagagttactgaccaggccagatactccgccctgggcaagagatctttggatgtttattttcagtgacacgatgcttctgaacattcctcttgtgatgaataatgaaagacataaaggtgagatggcctacatcgtggtgcagaaccacatgaacctttccgagaacgcttccaacaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcctgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccacgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggcaaaaaaaaaaaaaatgaattttattttacttgtcacacctgtcttaataaactggagttttgctgctaaagaa

SEQ ID NO: 177403 - DNA, 699 bp, Homo sapiens
  Payload ID: 14813
  Gene Symbol: RNF213
  Gene Name: ring finger protein 213
  ENST ID: ENST00000573038
  CDS Start-End: 1-319
gctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggtaggatgggcccgtggcttctctctgataccaggtggcatcccttggagcctgcatgttccctggtttatgtcaaatgatgcagggtgatggaccactgatgcagcccatcacgtgacactgtattggaagtcacgtgcccacagcctccagggcgcacctggctagtgtgcgtgaaccagtggctggaacaggacagctatgacagttgagctgggttgacagatttgctgtgtcttgctgatctgccaagtccatcagcagcgccttttgatttatgcccattacttcctttgagaccctgctggaaaacagtctaagaaagatgctgacacaactattaatagcaaaattcatacctagatgtattcataattcagatatgcatgtgtgtttaataaaaatacatatgttggtgtagtgtgggaagttaaaaaatataaagatgtttttagaatctaacctttaaa

SEQ ID NO: 177404 - DNA, 21055 bp, Homo sapiens
  Payload ID: 14813
  Gene Symbol: RNF213
  Gene Name: ring finger protein 213
  ENST ID: ENST00000582970
  CDS Start-End: 144-15767
cagcgcgcggcaggcggcgagctcgggggccgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaagcaaaaagaagaaaaggaagaagaaaaagaaggggaacaagtccgcttcctcagagctggcttccttgcccctttctcctgccagcccctgtcacctgactttgctttcaaacccgtggcctcaggacacagccctgccccacagccaagcccagcagagtggccccactggccagccgagccagcccccaggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcgatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccgtgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttgaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactgtgtgactccgccaggaacttggaatggctgaagactgtgaatgagagtcatgggtctgtggaacgctcatccctgaccctggccacggccatcaaccaaagaggcatctatgtgatccaggcgcccaaaggtggccaaaagatttccccagacacggttctgcacttgatccttcctgagagccctggcagccacgaggagtcacgagagtactctttagaggaggtgaaggagcttttgaacaagttgatgctgatgtctggcaagaaggatcgtaacaacacggaagtggagaggttttcagaggtcttctgcagtgtgcagaggctcagccaggccttcatcgacctgcactctgctgggaatatgctgttcaggacgtggatcgccatggcctactgctcccccaagcagggtgtgtccctccaaatggactttggcttggacctggtgacggagcttaaagaaggtggagatgtcactgagctgctggcagccctctgcaggcagatggagcacttccttgacagctggaagagatttgtgacccagaagcgaatggagcacttttacctgaacttctacacggcagagcagctggtttacctgagcactgagctcaggaagcagcccccgagtgatgccgccctaacgatgctatccttcatcaaaagcaactgcaccctgagggatgtcttaagggcctctgtggggtgtgggagtgaggccgccaggtaccgcatgaggagagtcatggaagagctcccgctgatgctcttatcagagttcagcctggtggacaagctgaggatcatcatggagcagtccatgaggtgccttcctgccttcctgcccgactgcctcgacctagagacccttggccactgtctggctcacctggcagggatgggtgggtctcccgtggagcgttgtctcccgagaggtctgcaggtcggccagcccaacctcgtcgtctgtggccactccgaggtgttgccagccgccctggctgtctacatgcaaaccccaagccagcccctgcccacttacgatgaggtgctgctctgcaccccggcaaccacctttgaggaggtggcactgttgctgcgccgctgcctgaccctgggctccctggggcacaaggtctacagcctgctgttcgcagatcagctgagctacgaggtggcacgccaagcggaggagcttttccacaatctgtgcacgcagcagcaccgagaagactaccagctcgtcatggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcggcggcagccgtgttcaatgaccggctgtgtgttgggatcgtggcctcggagcgagcaggtgttggaaagtctctgtacgtgaagaggttgcacgacaaaatgaagatgcagttaaacgtgaaaaatgtgcctctgaaaacaattcgactgatcgaccctcaggtggatgagagccgagtcctgggcgccctgctgcccttcctggatgcgcagtatcagaaggtccccgtgctctttcacctggacgtgacctcctcagtgcagactggaatttgggtgtttcttttcaagctcctcattttacaatacttaatggatataaatgggaaaatgtggcttcggaacccctgccatttgtatatcgttgaaatcctggaaaggaggacgtcagtgccgtcgaggagctcttcagcgctgcgtacacgtgtaccccagttcagttttcttgacatcttcccaaaagtcacctgcaggcctcccaaagaggtgatagacatggagctgagtgccctgaggagtgacacagagcctgggatggatctgtgggagttctgcagcgaaactttccaaagaccttaccagtatttaagacgattcaatcaaaaccaagacctagacacgtttcagtatcaagaaggctctgtcgaaggcaccccggaggaatgcctccagcatttcctgtttcactgcggggtaataaacccatcctggtcagagcttcggaactttgctcggttcctgaattatcagctcagagattgtgaggcctctctcttctgcaatccgagttttattggcgacacactgaggggcttcaagaagttcgtggtgaccttcatgatctttatggcaagagattttgccacaccatcactccacacctctgaccaaagcccggggaagcacatggtcaccatggatggggttagggaagaagatctagcgcccttctccctccggaagaggtgggagtcggagcctcacccatacgttttcttcaatgacgaccacacaaccatgacattcatcggcttccatctgcagcccaacatcaacggcagtgtcgatgccatcagtcacttgactgggaaggtcatcaagagagacgtcatgaccagggacctgtaccagggcctgctgctccagagggtgcccttcaatgtcgactttgataaactgcccagacacaagaaacttgagaggctctgcctgaccttagggatcccccaggccaccgaccccgacaaaacgtatgagctcacaaccgacaatatgcttaaaatccttgccatcgagatgcggttccggtgtgggatcccggttatcatcatgggagaaactggctgtgggaaaaccaggcttattaaattccttagcgacctgcggcgtggtggtaccaatgctgacaccataaagctggtcaaggtgcacggaggaacaactgcagacatgatctactccagagtcagggaggctgaaaatgtggccttcgccaataaggaccaacatcagttggacaccatcttgttttttgatgaagccaacacaacggaagctataagctgtatcaaagaagtcctgtgtgatcatatggtggatggccagcctctggctgaggactctggcctgcatattatagctgcctgcaatccataccggaagcactctgaggagatgatctgccgtttggagtcagctggtttgggctacagggttagtatggaggagacggccgacaggctgggctccattcctctgaggcagctggtataccgggtccatgctctgcccccgagcctgattcctctggtgtgggactttggacaactgagtgacgttgctgaaaagctctacatccagcagattgtccagagactggttgagtccatcagcctagatgaaaacgggactcgcgtgatcacagaagtcctctgcgcctctcagggtttcatgaggaaaacagaagatgagtgcagctttgtcagcctcagggacgtggagcgctgtgtgaaagttttcaggtggttccacgagcacagcgcgatgctcttagcgcagctgaatgcctttctctccaagtccagcgtcagcaaaaatcacaccgagagagatcccgtcctctggtcgttgatgctggccatcggggtgtgttaccatgcctctttagaaaagaaagactcatatcggaaagccatcgccaggttctttccgaaaccgtatgacgacagcaggctgcttctggatgaaataacacgggcacaggatctttttctggacggcgtacctctgaggaaaaccatcgccaagaacttggccttgaaggagaacgtcttcatgatggtcgtctgcatcgagctgaagattcccctcttcctggtggggaagcccggcagctccaagtctctcgccaagaccatcgtggcagacgccatgcagggcccggctgcctactcagatctcttccgcagcctgaagcaggtccacctggtgtccttccagtgcagcccgcactccaccccacagggcatcatcagcaccttccggcagtgcgcccgctttcagcaggggaaggacctgcagcagtacgtctctgtggtggtgttagatgaggtggggctggcggaagactcacccaaaatgcccctgaagactctgcacccgctgctggaagacggatgcattgaagacgatcccgccccccacaaaaaggtcggcttcgtgggcatctccaactgggcccttgaccctgccaagatgaaccggggcatttttgtgtcacgtggcagccccaacgagacagagctcatagagagcgccaagggcatctgctcctcagacatcctcgtccaggaccgagtccaagggtactttgcgtcctttgccaaagcctacgaaacggtgtgtaagcgccaggacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagtgctcagaggaagtcagccccatgcagctgatcaaacagaacatctttgggccttctcagaaggtgccgggtggagagcaggaagatgctgagtcccgctacttactcgtgctgaccaaaaactacgtggcactgcagatcctgcagcagacattcttcgagggggaccagcagccggagattatttttggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcggccagaagtacgtggacctcggtctggggacccaccgcgtcaaatgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttcaccagaaggtgtctgaggaggccaaatcgatcctgctgaactgcgctacgcccgatgccgtggtccggctgagcgcctactcgctgggcgggttcgcagcggagtggctgtcgcaggagtactttcacagacagaggcacaactcctttgcagatttccttcaggcacacctgcacacggcagacctggagcgccacgccatcttcacagagatcaccactttctccaggctgctaacaagtcacgactgtgaaattttagaatcagaggtcacaggcagggctccgaaacccacactcctgtggctgcagcagtttgacaccgagtactcattcctcaaagaagtccgaaactgtttaacgaatacagccaaatgtaaaatcctcatttttcagacagattttgaagatggaatccgtagcgcccagctcattgcctcagctaagtattctgttataaatgaaatcaacaaaatacgagaaaatgaggaccgtatcttcgtctatttcatcacaaaactgtcccgggtgggaagaggaacagcctatgtgggcttccacggagggctgtggcagtctgtccacatcgatgacctccggagatccaccctcatggtttctgatgtgaccaggctgcagcatgtcaccatcagccagctgttcgcgcccggagacttgcctgagctgggcttggaacaccgggcggaagacggccatgaggaggcgatggagacggaggccagcacatcaggggaggtggcagaggtggcagaggaggccatggaaacagaaagttctgagaaggtgggaaaggaaacctctgaactcggaggcagtgatgtgtcgatcctggacaccaccaggctgctgagaagctgtgtgcagagcgccgtgggcatgctcagagaccagaacgagagctgcacgcgcaatatgcggagggtggtgctcctcctgggcctcttgaatgaggatgacgcgtgccacgcctctttcttgcgggtatccaagatgcgcctcagtgtctttttaaagaagcaagaagagagccagtttcaccctctggagtggttggcaagggaagcctgcaaccaggacgctctccaggaggcgggcacattcaggcacaccctctggaagcgggtccaaggtgctgtcacccctctgctggcgagcatgatatcattcatcgacagagacggcaacctagagttactgaccaggccagatactccgccctgggcaagagatctttggatgtttattttcagtgacacgatgcttctgaacattcctcttgtgatgaataatgaaagacataaaggtgagatggcctacatcgtggtgcagaaccacatgaacctttccgagaacgcttccaacaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcctgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccacgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggcaaaaaaaaaaaaaatgaattttattttacttgtcacacctgtcttaataaactggagttttgctgctaaagaactcttctctctgggggcagagcttctatttatggcacatagacatcagctaggcttttgggaatcgtttgtgttctttgtggaaatgtcctttagaagcacccatgaagtagtgtgttcagactgtgcacacagaaaacaggctctgccttcacatgtgagacggtggacttttcctctggacaaaatgacagcatcctggcgactccacagtggagctgagcgccactccctgtagccgatctgggactgaaacgcttacacctctgcctcagaaggagtcccccatgccctgcctgaaatgacttcactggacacagcggggctgcagctaacggggtacaggtaggagctaactaacttcacccctgagtccacttgcggggtaagagataaacagtaacccttccaggagcccactgacgttggagtgctaaaaatgccccttcagggggaaaactgcattttctcttccaaaaaggaaaggttcttccaggcgagaaacctgtggtctagaaccacagcaagaagaggaggcatgctggcctgcaccggaagactcactttgtctgccctgcgccagcctcacctcaccctgcagttcccgtttccgccatggatgcctcatcaccaaccctgaccttccccctcccaaccctttattcatcctcactcccactcatacccgcctccctggacagttccctgctgcagagttctttctgctttcagccctaccttggtggtgatttacctgaaaatcttcacaactgatcattatctccttctctttgagacctgactgaaaaaattaggtgtgcacacctgtaatcccagctacctgggaggctgaggtatgaggattgcttgagcctgggagtttgaggctgcagtgagctatgattgcaccactgcactccaacctgggtgacagagtgagaccctgtctcaaaaaaaaataaaataaggaccttattgtgtgtgcaaattatttgcctttcatgaatagttatgagactttgtgcatgtgttaaccgagacggccctgagctatttcagttactcctgtatgttcaggcaattccaatttagaaacaaacttccagtgataaatattgggaagaaaatgtcagctcagggccaagtaggtaaagccacccaagtctagccatgcacacaggcactagtgtgctgaaggaaaacacctctgatttgatacataaagtgtgaaggttgcataactggggaggtggctggagaaaacctgagcctcgagctgagtaacaatccaagccatgattagcatttatattgcattctgcattattctcatcctatcacgttcattaagttcaaccattaccattacgaatcccgtttccagctggaaaaacaagcgccaggaaagtgcatttcccccccaccccccccccccaaccagagcaactttggtcagaagtcacacctaatcaccctctctgcaggatatgctggggatagcccttttgaggaggtgggggtgtatgcgaaagcaacctggggccaaagcagggggaagcaggagagactggaggggccctgggtccagcaagtgctccaccaggctgcccctgctcaggtgctccacagcccataaaaaacgccttcagccctgctgtgcttcccctcacacctaaacttactataagggtcctaccttccccagtattccttcatgatcactgctacctgtgccctgaagcgcaacagaacctcaacccagaggacagccacttcctcagaacccacgatctttgccccatcgccacaggtccatgagtgactcctaattaccaaatccaagggctccttcaccctgaccactctggaacccaacaaagctgacacacagcccagcccagacaggcctgaatgtgggtcctggctctcccatttgccagttctacagccatgggcaagtggctcgacctctctaagcttcagtttcctcgtctgtgaaatatctgtcagtgctcttaagggaggagaccaccccacatattgtcttacgcccaatttctgcctccaaagagagaagtaaaaactaaaaggcagaaatgaaatccacaagcagacagcctgcaccacaccctgggcctggtagttaaagatcgacgcctgacctaatcagtgatgctatctatagattacagacattatatagaaaagcaccgtgaaaatccctgtcctgttctgttccgttctaattacgggtgcatgcagcccccagtcacgtaccccctgcttgctcaatcaatcacgaccctctcacgcagaccccttaagagttgtgagcccttaaaagggacaggaattgctcactcggggagctcagttgttggagacatgagtcttgccgaagcgcccggctgaataaagcccttctttaactcgtgtctgaggggttttctctgcagcttgtcctgctacatttcttggttccctgaccaggaatctaggtgattaatggatggttgaggcagcccctcagacggcttaggcctgccctgtggagcatccctgtggaggactccagccagcttgagcgacatggatcctgagagcgctctcaggcaggcaattgccccagtggaatgcctggccagagcagtgtgtagcaggcccccgaggaggatcaacgcagtggctgaacaccgggaaggaactgccacttggagtccagacatctgaaacttggtaagactggtctttggaacttgcccactccatttgaggggaagcgtggcctgatcacccacggcgtgcctgtactggcactctggtttttgtttttgacttgacttggattgcttgatactttggttttggttttgacctgacttggatatcctgatactctgattttggttttgattttggtttggtgtaaactgtaaaagtgtgtgtgtgccctttttacctgttctttgttttgtggtatgcgtgtagggtgagcgtaatgttttgtcttgaagaagcatgggtcaagcacaaagtaagaccaccccactaggaactatgctgaaaaatttcaggaaaggatttaagggagactatggagtactatgacaccaggaaaacttaaaactttgtgtaagatagactggccagcattagaggtaggttggccatcagagtgaagcctggacaggtcccttgtttcaaaggtatggcacaaggtaacctgtaagccagggtacccacaccagttcccgtacacagacacttggttacagctggttttagactccccacccgcccgccccaacagtggttgagagaacagcagcataagtggctggcagaggcaaggaaagaccagcagagagagaaagaggaagagacagacaaagagggagtcagagagagagagagaaagagacagaggcaaaaggaaagtcaaagagaaagagacagaaaatcaagaggaaaaaaa

SEQ ID NO: 177405 - DNA, 2755 bp, Homo sapiens
  Payload ID: 14814
  Gene Symbol: RNF214
  Gene Name: ring finger protein 214
  Uniprot ID: Q8ND24
  ENST ID: ENST00000300650
  CDS Start-End: 109-2220
ctccgctcgtgccgccggaagtgggaggtgccgcgcgcgggccggcgctcgacccctccccccgtggctcggccgccccctccccccgctccgcccgctcagagcataatggcagcgtctgaggttgctggtgttgtggccaatgcccccagtcctccggaatcttctagtttatgtgcttccaaatcagacgaaggtctcccagatggtctaagcaccaaagactctgcacagaagcagaagaactcgcctctgttgagtgtaagtagccaaacaataaccaaggagaataacagaaatgtccatttggagcactcagagcagaatcctggttcatcagcaggtgacacctcagcagcgcaccaggtggttttaggagaaaacttgatagccacagccctttgtctttctggcagtgggtctcagtctgatttgaaggatgtggccagcacagcaggagaggagggggacacaagccttcgggagagcctccatccagtcactcggtctcttaaggcagggtgccatactaagcagcttgcctccaggaattgctctgaagagaaatccccacaaacctccatcctaaaggaaggtaacagggacacaagcttggatttccgacctgtagtgtctccagcaaatggggttgaaggagtccgagtggatcaggatgatgatcaagatagctcttccctgaagctttctcagaacattgctgtacagactgactttaagacagctgattcagaggtaaacacagatcaagatattgaaaagaatttggataaaatgatgacagagagaaccctgttgaaagagcgttaccaggaggtcctggacaaacagaggcaagtggagaatcagctccaagtgcaattaaagcagcttcagcaaaggagagaagaggaaatgaagaatcaccaggagatattaaaggctattcaggatgtgacaataaagcgggaagaaacaaagaagaagatagagaaagagaagaaggagtttttgcagaaggagcaggatctgaaagctgaaattgagaagctttgtgagaagggcagaagagaggtgtgggaaatggaactggatagactcaagaatcaggatggcgaaataaataggaacattatggaagagactgaacgggcctggaaggcagagatcttatcactagagagccggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccactttacctccacccccatcagagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccctttcccagcccagccagccttcctcaccccttcctggctcccatggcagaaatagccctggcttgggttcccttgtcagcccccacggtccacacatgccccctgccgcctccatcccacctcccccaggcttgggcggtgttaaggcttctgctgaaactccccggccccaaccagtagacaaactggagaagatcctggagaagctgctgacccggttcccacagtgcaataaggcccagatgaccaacattcttcagcagatcaagacagcacgtaccaccatggcaggcctgaccatggaggaacttatccagttggttgctgcacgactggcagaacatgagcgggtggcagcaagtactcagccacttggtcgcatccgggccttgttccctgctccactggcccaaatcagtaccccaatgttcttgccttctgcccaagtttcatatcctggaaggtcttcacatgctccagccacctgtaagctatgtctaatgtgccagaaactcgtccagcccagtgagctgcatccaatggcgtgtacccatgtattgcacaaggagtgtatcaaattctgggcccagaccaacacaaatgacacttgtcccttttgtccaactcttaaatgacggacctgactggggaggaagaagaagagaaactgatgtgaacaggaagcgcgggttcaagatttctaaaactctatatttatacagtgacatatactcatgccatgtacatttttattatataggtaatgtgtgtatagaaagtctgtattccaatgttcgtaaatgaaactatgtatattatgcagaaacagtctgttccccctcatcttgcaattcctttgggggatgcagattgtagggaagatgatgtttagtttggccttgaaattatgatatccctgcccagggctgttttcaaatacaatataaaaaccacctaggaacctgctgttgctctaaggccattctgctttggtttggctcagcctctagtccatttccttaaggctcatgtatgcagatttaaagcctggtgctcacccactgtccaaccagatgccttgcttaccgaaagcctccagaagcctcagtattgttttagccactctactccaaatggataaaatgagactctgattgaggaaaaaaaagt

SEQ ID NO: 177406 - DNA, 2695 bp, Homo sapiens
  Payload ID: 14814
  Gene Symbol: RNF214
  Gene Name: ring finger protein 214
  Uniprot ID: Q8ND24
  ENST ID: ENST00000531452
  CDS Start-End: 47-2158
gtccctcccccactttcctcccgggggcgcggcgcgggagagcataatggcagcgtctgaggttgctggtgttgtggccaatgcccccagtcctccggaatcttctagtttatgtgcttccaaatcagacgaaggtctcccagatggtctaagcaccaaagactctgcacagaagcagaagaactcgcctctgttgagtgtaagtagccaaacaataaccaaggagaataacagaaatgtccatttggagcactcagagcagaatcctggttcatcagcaggtgacacctcagcagcgcaccaggtggttttaggagaaaacttgatagccacagccctttgtctttctggcagtgggtctcagtctgatttgaaggatgtggccagcacagcaggagaggagggggacacaagccttcgggagagcctccatccagtcactcggtctcttaaggcagggtgccatactaagcagcttgcctccaggaattgctctgaagagaaatccccacaaacctccatcctaaaggaaggtaacagggacacaagcttggatttccgacctgtagtgtctccagcaaatggggttgaaggagtccgagtggatcaggatgatgatcaagatagctcttccctgaagctttctcagaacattgctgtacagactgactttaagacagctgattcagaggtaaacacagatcaagatattgaaaagaatttggataaaatgatgacagagagaaccctgttgaaagagcgttaccaggaggtcctggacaaacagaggcaagtggagaatcagctccaagtgcaattaaagcagcttcagcaaaggagagaagaggaaatgaagaatcaccaggagatattaaaggctattcaggatgtgacaataaagcgggaagaaacaaagaagaagatagagaaagagaagaaggagtttttgcagaaggagcaggatctgaaagctgaaattgagaagctttgtgagaagggcagaagagaggtgtgggaaatggaactggatagactcaagaatcaggatggcgaaataaataggaacattatggaagagactgaacgggcctggaaggcagagatcttatcactagagagccggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccactttacctccacccccatcagagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccctttcccagcccagccagccttcctcaccccttcctggctcccatggcagaaatagccctggcttgggttcccttgtcagcccccacggtccacacatgccccctgccgcctccatcccacctcccccaggcttgggcggtgttaaggcttctgctgaaactccccggccccaaccagtagacaaactggagaagatcctggagaagctgctgacccggttcccacagtgcaataaggcccagatgaccaacattcttcagcagatcaagacagcacgtaccaccatggcaggcctgaccatggaggaacttatccagttggttgctgcacgactggcagaacatgagcgggtggcagcaagtactcagccacttggtcgcatccgggccttgttccctgctccactggcccaaatcagtaccccaatgttcttgccttctgcccaagtttcatatcctggaaggtcttcacatgctccagccacctgtaagctatgtctaatgtgccagaaactcgtccagcccagtgagctgcatccaatggcgtgtacccatgtattgcacaaggagtgtatcaaattctgggcccagaccaacacaaatgacacttgtcccttttgtccaactcttaaatgacggacctgactggggaggaagaagaagagaaactgatgtgaacaggaagcgcgggttcaagatttctaaaactctatatttatacagtgacatatactcatgccatgtacatttttattatataggtaatgtgtgtatagaaagtctgtattccaatgttcgtaaatgaaactatgtatattatgcagaaacagtctgttccccctcatcttgcaattcctttgggggatgcagattgtagggaagatgatgtttagtttggccttgaaattatgatatccctgcccagggctgttttcaaatacaatataaaaaccacctaggaacctgctgttgctctaaggccattctgctttggtttggctcagcctctagtccatttccttaaggctcatgtatgcagatttaaagcctggtgctcacccactgtccaaccagatgccttgcttaccgaaagcctccagaagcctcagtattgttttagccactctactccaaatggataaaatgagactctgattgaggaaaaaaaagtaa

SEQ ID NO: 177407 - DNA, 2846 bp, Homo sapiens
  Payload ID: 14814
  Gene Symbol: RNF214
  Gene Name: ring finger protein 214
  ENST ID: ENST00000530849
  CDS Start-End: 11-1552
acagagcataatggcagcgtctgaggttgctggtgttgtggccaatgcccccagtcctccggaatcttctagtttatgtgcttccaaatcagacgaaggtctcccagatggtctaagcaccaaagactctgcacagaagcagaagaactcgcctctgttgagtactgactttaagacagctgattcagaggtaaacacagatcaagatattgaaaagaatttggataaaatgatgacagagagaaccctgttgaaagagcgttaccaggaggtcctggacaaacagaggcaagtggagaatcagctccaagtgcaattaaagcagcttcagcaaaggagagaagaggaaatgaagaatcaccaggagatattaaaggctattcaggatgtgacaataaagcgggaagaaacaaagaagaagatagagaaagagaagaaggagtttttgcagaaggagcaggatctgaaagctgaaattgagaagctttgtgagaagggcagaagagaggtgtgggaaatggaactggatagactcaagaatcaggatggcgaaataaataggaacattatggaagagactgaacgggcctggaaggcagagatcttatcactagagagccggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccactttacctccacccccatcagagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccctttcccagcccagccagccttcctcaccccttcctggctcccatggcagaaatagccctggcttgggttcccttgtcagcccccacggtccacacatgccccctgccgcctccatcccacctcccccaggcttgggcggtgttaaggcttctgctgaaactccccggccccaaccagtagacaaactggagaagatcctggagaagctgctgacccggttcccacagtgcaataaggcccagatgaccaacattcttcagcagatcaagacagcacgtaccaccatggcaggcctgaccatggaggaacttatccagttggttgctgcacgactggcagaacatgagcgggtggcagcaagtactcaggctccagccacctgtaagctatgtctaatgtgccagaaactcgtccagcccagtgagctgcatccaatggcgtgtacccatgtattgcacaaggagtgtatcaaattctgggcccagaccaacacaaatgacacttgtcccttttgtccaactcttaaatgacggacctgactggggaggaagaagaagagaaactgatgtgaacaggaagcgcgggttcaagatttctaaaactctatatttatacagtgacatatactcatgccatgtacatttttattatataggtaatgtgtgtatagaaagtctgtattccaatgttcgtaaatgaaactatgtatattatgcagaaacagtctgttccccctcatcttgcaattcctttgggggatgcagattgtagggaagatgatgtttagtttggccttgaaattatgatatccctgcccagggctgttttcaaatacaatataaaaaccacctaggaacctgctgttgctctaaggccattctgctttggtttggctcagcctctagtccatttccttaaggctcatgtatgcagatttaaagcctggtgctcacccactgtccaaccagatgccttgcttaccgaaagcctccagaagcctcagtattgttttagccactctactccaaatggataaaatgagactctgattgaggaaaaaaaagtaaccctagtagtttgacttcttattgaatattttactgtgttaacgctcattatttatacagacattaggtttacagaatattctgttttacatcaccaaaattcacagtccgagaataacaacataaccaggtcccaattcctccatgtaccccacaagcttctgtccaccctattttctggacagaaattagcacaacccacaggtttttcctgggccaagtcttcctttgctgccactgtcttggcttctaatcaagctctgacaggccaacattgtgaagtcctcaccctttcccattcacttctggtctcctagtctagctaatccccctcccccagaaggttaaggcagttggttcacaaccaagttgtttggtgaccttgggtgagctccagacaggcactggggtgaggagatgtctgtgcaaaattacttgtagaatgatcttgggatgctggattttaatttttgaagcaagaaagttagggggggacatatttcctgtcctgggaaaaatggagaccaaagtgatattaagaaagtagtttggatttcaaatttataaatcacttgctctgtgggtagctatcaggaactagatcattttccacctctgcttattgtacttcttaattttaggttttatacctgggaaagctgtgactctattagagctttgaatcttttcctatccttttatctttactcctacagggaatggcctcagctcccttctcttttagaattaaacaagt

SEQ ID NO: 177408 - DNA, 548 bp, Homo sapiens
  Payload ID: 14814
  Gene Symbol: RNF214
  Gene Name: ring finger protein 214
  ENST ID: ENST00000534428
  CDS Start-End: 109-548
ctccgctcgtgccgccggaagtgggaggtgccgcgcgcgggccggcgctcgacccctccccccgtggctcggccgccccctccccccgctccgcccgctcagagcataatggcagcgtctgaggttgctggtgttgtggccaatgcccccagtcctccggaatcttctagtttatgtgcttccaaatcagacgaaggtctcccagatggtctaagcaccaaagactctgcacagaagcagaagaactcgcctctgttgagtgtaagtagccaaacaataaccaaggagaataacagaaatgtccatttggagcactcagagcagaatcctggttcatcagcaggtgacacctcagcagcgcaccaggtggttttaggagaaaacttgatagccacagccctttgtctttctggcagtgggtctcagtctgatttgaaggatgtggccagcacagcaggagaggagggggacacaagccttcgggagagcctccatccagtcactcggtctcttaaggcagggtgccatactaagcagcttgcctccag

SEQ ID NO: 177409 - DNA, 1706 bp, Homo sapiens
  Payload ID: 14814
  Gene Symbol: RNF214
  Gene Name: ring finger protein 214
  Uniprot ID: Q8ND24
  ENST ID: ENST00000531287
  CDS Start-End: 47-1693
gtccctcccccactttcctcccgggggcgcggcgcgggagagcataatggcagcgtctgaggttgctggtgttgtggccaatgcccccagtcctccggaatcttctagtttatgtgcttccaaatcagacgaaggtctcccagatggtctaagcaccaaagactctgcacagaagcagaagaactcgcctctgttgagtactgactttaagacagctgattcagaggtaaacacagatcaagatattgaaaagaatttggataaaatgatgacagagagaaccctgttgaaagagcgttaccaggaggtcctggacaaacagaggcaagtggagaatcagctccaagtgcaattaaagcagcttcagcaaaggagagaagaggaaatgaagaatcaccaggagatattaaaggctattcaggatgtgacaataaagcgggaagaaacaaagaagaagatagagaaagagaagaaggagtttttgcagaaggagcaggatctgaaagctgaaattgagaagctttgtgagaagggcagaagagaggtgtgggaaatggaactggatagactcaagaatcaggatggcgaaataaataggaacattatggaagagactgaacgggcctggaaggcagagatcttatcactagagagccggaaagagttactggtactgaaactagaagaagcagaaaaagaggcagaattgcaccttacttacctcaagtcaactcccccaacactggagacagttcgttccaaacaggagtgggagacgagactgaatggagttcggataatgaaaaagaatgttcgtgaccaatttaatagtcatatccagttagtgaggaacggagccaagctgagcagccttcctcaaatccctactcccactttacctccacccccatcagagacagacttcatgcttcaggtgtttcaacccagtccctctctggctcctcggatgcccttctccattgggcaggtcacaatgcccatggttatgcccagtgcagatccccgctccttgtctttcccaatcctgaaccctgccctttcccagcccagccagccttcctcaccccttcctggctcccatggcagaaatagccctggcttgggttcccttgtcagcccccacggtccacacatgccccctgccgcctccatcccacctcccccaggcttgggcggtgttaaggcttctgctgaaactccccggccccaaccagtagacaaactggagaagatcctggagaagctgctgacccggttcccacagtgcaataaggcccagatgaccaacattcttcagcagatcaagacagcacgtaccaccatggcaggcctgaccatggaggaacttatccagttggttgctgcacgactggcagaacatgagcgggtggcagcaagtactcagccacttggtcgcatccgggccttgttccctgctccactggcccaaatcagtaccccaatgttcttgccttctgcccaagtttcatatcctggaaggtcttcacatgctccagccacctgtaagctatgtctaatgtgccagaaactcgtccagcccagtgagctgcatccaatggcgtgtacccatgtattgcacaaggagtgtatcaaattctgggcccagaccaacacaaatgacacttgtcccttttgtccaactcttaaatgacggacctgactgg

SEQ ID NO: 177410 - DNA, 1651 bp, Homo sapiens
  Payload ID: 14815
  Gene Symbol: RNF215
  Gene Name: ring finger protein 215
  ENST ID: ENST00000215798
  CDS Start-End: 1-1030
cgtgagactgccgcgccaggacgctctggtcctggagggcgtcaggatcggctccgaagccgacccggcgcccctgctgggcggtcgtctgctgctgatggacatcgtggatgccgagcaggaggcaccagtggaaggctggattgcagtggcatacgtgggcaaggagcaggcggcccagttccaccaggagaataagggcagtggcccgcaggcctatcccaaggccctggtccagcagatgcggcgggccctcttcctgggtgcctctgccctgcttcttctcatcctgaaccacaacgtggtccgagagctggacatatcccagcttctgctcaggccagtgatcgtcctccattattcctccaatgtcaccaagctgttggatgcattgctgcagaggacccaggccacggctgagatcaccagcggagagtccctgtctgccaatatcgagtggaagttgaccttgtggaccacctgtggcctctccaaggatggctatggaggatggcaggacttggtctgccttggaggcagtcgtgcccaggagcagaaacccctgcagcagctgtggaacgccatcctgctggtggccatgctcctgtgcacaggcctcgtggtccaggcccagcggcaggcgtcgcggcagagccagcgggagctcggaggccaggtggacctgtttaagcgccgcgtggtgcggagactggcatccctcaagacacggcgctgccggctgagcagggcagcgcagggcctcccagatccgggtgctgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctgggtgagcaccaggggtggggtccctcggcctactctgcctgctcctcacctgatgcctctctccctgttcttcttcccctcccctgcagggaaccgctactccgatgattagctgcccagctggactctgcacatggggatggacccttcctgcctgcaccccggtcctcagcctgggctcccaggacaggacaggatgggacagcaggatagacaggacagcaagcccagtgggtgggaggaaggatgagggccccaccatgtccacactgggaaggagggccccacagcttcagactgaggatctagggctgggacctgtcagtcaaggaagagaggtcactttgggaccttctctgcaatcctgtgacgtgagtctgccctccttacaggcagctcccaggtcaataaggaaagagaatatggggccagtgtagctgtcgccagggttctgggagctccctgtggcctgtctgggaattcctgggggctgagactacagtggccaggttttgtgcttatttattggggggtgggttgagggaagagctatctggccttggggtaccctggcctgaccgtctttcaggatacttcttgtcaaggctgtctgcctgttgcctttggtcctcaagcactgggagccatgggtcccactgcctgtccagcctggctcccttcctgggcctggctaggaccagaggtcttagaaaccgtcctgttctggaa

SEQ ID NO: 177411 - DNA, 1992 bp, Homo sapiens
  Payload ID: 14815
  Gene Symbol: RNF215
  Gene Name: ring finger protein 215
  Uniprot ID: Q9Y6U7
  ENST ID: ENST00000382363
  CDS Start-End: 76-1209
ggcctcgctccctccgatcccccccgcgcccgggacccctggccccactgttgggccagctcgccgggtccggccatgggccccgccgctcgccccgcgctgagatcgccgccgccgcctccgccgccgcctccgtctccgctgctgctgctgctgcccctgctgccgctgtggctgggcctggcggggcccggggccgcggcggacggcagcgagccggcggccggggcggggcggggcggagcccgcgccgtgcgggtggacgtgagactgccgcgccaggacgctctggtcctggagggcgtcaggatcggctccgaagccgacccggcgcccctgctgggcggtcgtctgctgctgatggacatcgtggatgccgagcaggaggcaccagtggaaggctggattgcagtggcatacgtgggcaaggagcaggcggcccagttccaccaggagaataagggcagtggcccgcaggcctatcccaaggccctggtccagcagatgcggcgggccctcttcctgggtgcctctgccctgcttcttctcatcctgaaccacaacgtggtccgagagctggacatatcccagcttctgctcaggccagtgatcgtcctccattattcctccaatgtcaccaagctgttggatgcattgctgcagaggacccaggccacggctgagatcaccagcggagagtccctgtctgccaatatcgagtggaagttgaccttgtggaccacctgtggcctctccaaggatggctatggaggatggcaggacttggtctgccttggaggcagtcgtgcccaggagcagaaacccctgcagcagctgtggaacgccatcctgctggtggccatgctcctgtgcacaggcctcgtggtccaggcccagcggcaggcgtcgcggcagagccagcgggagctcggaggccaggtggacctgtttaagcgccgcgtggtgcggagactggcatccctcaagacacggcgctgccggctgagcagggcagcgcagggcctcccagatccgggtgctgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctggggaaccgctactccgatgattagctgcccagctggactctgcacatggggatggacccttcctgcctgcaccccggtcctcagcctgggctcccaggacaggacaggatgggacagcaggatagacaggacagcaagcccagtgggtgggaggaaggatgagggccccaccatgtccacactgggaaggagggccccacagcttcagactgaggatctagggctgggacctgtcagtcaaggaagagaggtcactttgggaccttctctgcaatcctgtgacgtgagtctgccctccttacaggcagctcccaggtcaataaggaaagagaatatggggccagtgtagctgtcgccagggttctgggagctccctgtggcctgtctgggaattcctgggggctgagactacagtggccaggttttgtgcttatttattggggggtgggttgagggaagagctatctggccttggggtaccctggcctgaccgtctttcaggatacttcttgtcaaggctgtctgcctgttgcctttggtcctcaagcactgggagccatgggtcccactgcctgtccagcctggctcccttcctgggcctggctaggaccagaggtcttagaaaccgtcctgttctggaatccttggctgcggctttgtgttgctgaccgggatactcgaagccacaggatcaatgtggtgcctcatccaggggcatccttttttttttttttttttttttttaaagagttggagtagggaaggtttaatagtaaaataaacgtggctatattttaacataagatg

SEQ ID NO: 177412 - DNA, 361 bp, Homo sapiens
  Payload ID: 14815
  Gene Symbol: RNF215
  Gene Name: ring finger protein 215
  ENST ID: ENST00000421022
  CDS Start-End: 1-105
gactgtgtggacccctggctgatgctccagcagacctgcccactgtgcaaattcaacgtcctggatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttg

SEQ ID NO: 177413 - DNA, 535 bp, Homo sapiens
  Payload ID: 14815
  Gene Symbol: RNF215
  Gene Name: ring finger protein 215
  ENST ID: ENST00000431544
  CDS Start-End: 237-535
acacagtgaggaaatgacagagctggagtttccgtctgttccacattgctgcatttgttctgcctgacttggaccctggaaaacctggccctcttcaatttctgacaaaagagacggagtttcactcttgtcgcccaggctggattccaatggcgcgatctcggctcgccgcaacctccgcctcccgggttcaagcgattctcctgcctcagcctcctgagtagctggaattacagatggacatcgtggatgccgagcaggaggcaccagtggaaggctggattgcagtggcatacgtgggcaaggagcaggcggcccagttccaccaggagaataagggcagtggcccgcaggcctatcccaaggccctggtccagcagatgcggcgggccctcttcctgggtgcctctgccctgcttcttctcatcctgaaccacaacgtggtccgagagctggacatatcccagcttctgctcaggccagtgatcgtcctccattattcctccaatgtcaccaagctgttggatgcattgct

SEQ ID NO: 177414 - DNA, 468 bp, Homo sapiens
  Payload ID: 14815
  Gene Symbol: RNF215
  Gene Name: ring finger protein 215
  ENST ID: ENST00000631046
  CDS Start-End: 1-93
caccgagactgtgtggacccctggctgatgctccagcagacctgcccactgtgcaaattcaacgtcctggggaaccgctactccgatgattagctgcccagctggactctgcacatggggatggacccttcctgcctgcaccccgatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttggtgggcgcctgagagagctactcagc

SEQ ID NO: 177415 - DNA, 555 bp, Homo sapiens
  Payload ID: 14815
  Gene Symbol: RNF215
  Gene Name: ring finger protein 215
  ENST ID: ENST00000619645
  CDS Start-End: 85-492
gagctgtccaaggtcacacggccagctcaagcttgggaacggcaggaattccgccaggctgctcttcccctgcttttgtgatggatgcttccttctggctccaggagcccgggagaattgctgccccttctggttcagtttcctgctatgggaaatagctatggggctatgacctgcctcacaaggtggttgagaaggggacagaagggcctggatgatgtctcacgagcagctaactgcacatcttcctgccagctctgcaaaaggatttgccctagtgctttaggggtctggaggggctgggagaacccaggtcacctgatatccaatcctgtgccaagatgggtacctagcactcctatgccatggggtccaggacagtgggcagctggaggctgtgtccttgggactagtcccatggtgtggtttggggacccattccaagaaccaagaagggggacacacagaagtcgagcaagaattagcatgtgacgtagtgaagagcacaggctgtggggacaaccagacctgtgtctgcgtttggctgttgtgact

SEQ ID NO: 177416 - DNA, 534 bp, Homo sapiens
  Payload ID: 14815
  Gene Symbol: RNF215
  Gene Name: ring finger protein 215
  ENST ID: ENST00000630264
  CDS Start-End: 1-93
caccgagactgtgtggacccctggctgatgctccagcagacctgcccactgtgcaaattcaacgtcctggggaaccgctactccgatgattagctgcccagctggactctgcacatggggatggacccttcctgcctgcaccccggtcctcagcctgggctcccaggacaggacaggatgggacagcaggatagacaggacagcaagcccaatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttggtgggcgcctgagagagctactcagc

SEQ ID NO: 177417 - DNA, 8141 bp, Homo sapiens
  Payload ID: 14815
  Gene Symbol: RNF215
  Gene Name: ring finger protein 215
  ENST ID: ENST00000332468
  CDS Start-End: 1-177
caccgagactgtgtggacccctggctgatgctccagcagacctgcccactgtgcaaattcaacgtcctgggtgagcaccaggggtggggtccctcggcctactctgcctgctcctcacctgatgcctctctccctgttcttcttcccctcccctgcagggaaccgctactccgatgattagctgcccagctggactctgcacatggggatggacccttcctgcctgcaccccggtcctcagcctgggctcccaggacaggacaggatgggacagcaggatagacaggacagcaagcccaatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttggtgggcgcctgagagagctactcagctgtgaggtccttcccctggacttgagcacaggccttctggctcagggtgctgagggatggtgctcccctgtgaggggggtgcccggggcaccccagcctccctcaggaactcccaggcccctcagaagcaggaagttgggctgaccaaagctgtggtagctcagctatatacatggcccctcttgacccttctctgtgaactgaggtgctctacctgacggcctcttcaccaagggaaaatgcttcaggcatttgggagcgtgcgccctgagaaggcctcagcaagtttttggagattgtccttcacagaaacggggtcccattatattgtccaggctggtctcaaactcctgggctcgagtgatctgcccgcctcagcctctcaaattgttgggattacaggcatgagccgccgcacccggcctgacgaggcttcttgctgcacttaaaggaatgacagctatagagggcatatgggactggaaggcatcggatccataacatcctcacgccttctggaaatgtgaaaaatgtttcacaaaagcacagcctaaggcctcatgtgatgaggtgggctctccacaagttcccggggcagagtctgaagacctgctgctggataggggcttcctcctggtccccaagggcccgccctctcaggcccaccttgaggccaccctgctgggccacttcccggattttggacagcattgattggagccgcccgttctcctcctgtaggacccggatgcggatgtcgttggactgcacttgcctctccatgtgatctgtgacgttgccagagtctgtgggacatgttatctgggattccacgctgctggatctgcctcctgtgcccaatgggacaggaccttagaagggaggcacaccagcttgggcaggtggcctggaggcacaaaggagctgtgtagtgcaccaggcctcctagctcatcttccttctcccgaggccttattcccccttccctgtcccccaacctgcagggaagatgaccatagtattataaaatctgagagctgggtgggacctagagctctcaaaagacttagcaaggccgggcgcggtggctcacgcctgtaatcccagcactttgggaggcccaggtcaggggatcattaagtcaagagatcaagaccatcctggccaacatggtgaaaccccgtctctactaaaaatagaaaaatgagctgggtgtggtggcgggcccccgtagtcccagctactcaggaggctgaggcaggagaatcacttgaacccaggaggtggaggttgcagtgagcagagattgtgccactgcactccagcctggcaacagagtgagactctgtctcaaaaaaaaaaaaaaaaaaaaaaagacttagcaaataagcatgagaggagagtgaatctctgacaaggcccccccgttttggacaggctacagccaaagtgagctgtccaaggtcacacggccagctcaagcttgggaacggcaggaattccgccaggctgctcttcccctgcttttgtgatggatgcttccttctggctccaggagcccgggagaattgctgccccttctggttcagtttcctgctatgggaaatagctatggggctatgacctgcctcacaaggtggttgagaaggggacagaagggcctggatgatgtctcacgagcagctaactgcacatcttcctgccagctctgcaaaaggatttgccctagtgctttaggggtctggaggggctgggagaacccaggtcacctgatatccaatcctgtgccaagatgggtacctagcactcctatgccatggggtccaggacagtgggcagctggaggctgtgtccttgggactagtcccatggtgtggtttggggacccattccaagaaccaagaagggggacacacagaagtcgagcaagaattagcatgtgacgtagtgaagagcacaggctgtggggacaaccagacctgtgtctgcgtttggctgttgtgactagaggcagtcacatcactgttgggctttcacgtccctgtctatgcagagtggatgacgcatgaagcacttgcgtgctgtggtgggtccacaggggctgcgctgctggccgcctggctttaacacccttgctgcaggctagggagctgcagtccccagtgtcctgcccacacgagccctcagctgctggccctgagccccagcatgcccttggcaccatccccagtcccctaccatggatctgggtctcggtgggcctgtgcaggtctgggaaggccaccagcagccgctcccgctccttcagctcctccagctcccgttctagctccaggatggttagccgcaggtccgtagtcgcctgctccaggccttgcttctccctctgcaggctctgcagcagctcctgggacagacggaggctcaggcctggctcctgagtgagctacatggtactcagcgccctggggcaccgtccctacccaagaaaagacatgggacaggcctgcaggcactcagttggccggagacttctctggcaaaaaggaagacccccaccctcacctgctgggccctgagctggcattgcccctgctcccgctcgctctgcagctgctcctccacgcgggcccgctgggcctcagcctcgtccaggctgccccgcagctcctcacgttcctggtccaggctgtccagctgctttagcagggctcgctgcttggcctgcagagactaagcaggaacggacaagcagggaggctgtgagacccacagggctaggcccagccatgtggaactaaggaggctacagcatctactacccctcggctgctacccccctggggtgtgtgtctgtgtctagggaatgctggtcacatgcgtggaagggtaggggtcgggggaagctggcagcaggcagatgcacaccggacctggtcaaggccaggatcccagcttgaagaccccggcccttggaacgcagatggctggctctgggggtctcacccccacttccttccagtcatacacagaccccacttggagaggaattctgggaactaagtttttcttctcctcgggtctccagtgtcacatcatcccatgttgctgaagcccacatttcctaacacccactgaatggaaagcaggaagaactaacgctggactgctcggagtcctggctccacctctcactagctgtgtggccttgggcaacttccttaacctcactcaataaggctgtttcctcattcgtaaaatgggggtgacaagagtatctacctcctgttgctgtagcgaggagtaagcatcagaggctgcggcgcctgaagcctgggtcacagcagacacctgatacatggcggctgtgacagtttgcaaggcacagagaacagcacccacttggggtagaaaggcttcccctaccctgggcccatgtctgaccctggggactctcaactgaactcctggctccttgctgagcttttgagggttagacccagccaagacagcccccagacctgcccctttcactaggcaacaggtcacctactccctcaaccacacttctgaggactcctgtgaggccccattgcccagagcacagctatgccccgggccctggctcaccctctgcctgccctgtccttcccctggctgatggactaattgcctgtcatgggcgtccagctcaaaggccacctcctcctagaagccattctggattcccatggcagatgtggccatccctccctgcaccccttagccatctggcaggagagtgtggcacacctgctcatctttgcctgtggggcgctcttccagagtgaggcctcactgggcagtatcagtccctgggtcactgttcccccagtgcctggttcagggtagactctctgtaaaggtgagtcaacccccacacctggaggcatctcagggagcagatgcccaatatagatgatcccccattccctgacagtggagccctctttccctgcagcctacattgcagatgcccaggctagcgagggccctggcctcacctcctggtggcggaccatgctgtcgacacgggccttctccttatccagctccgtgctggcccagcagacctgctggccagcgccctccagccgacccaccaacagctgcacctgcgcctccaactgctgcacctgctcctccagctgctgcacctgcctctccgctgccgccctgcgctcaccttcctcctgcagctgctgggcctttgcctctgcagcattaagtggacatgggatggggtagggcaggggagcgctgtactacctcagacctaggacgggagctcacatcccatctctgggcctcagagtcctcagccacaaaatggggctctagaccccacctgaggtgggtttggaaaatagaaggcgctttctcggtaggaggtggcaacccagtttggtcatcgccaatagtgtggttggtcaggcccaccctcctgtggctggttcccttcaactttgccctggatgctcaggggacagagatggacgatgctcatccagccacacccctggcttgagatgtggcatgggggcctatgatggggctccttacccacagcctgtgtggactcccgctgctgtttcagttctctctccagggtggccatctttgtctttaggtcacttgtttctatggcagccaagagagaggcccttcagagggtcccatggacctggccggcggccttcatgcccagtgtgccccgtggagtggaggcagcccatcgcctgcagaggggccgcctgcggccatgggaggagctctagggaggctggtggaagcggctgggcccttacccaccctgcttctcatgggctggctgccatgtgtctacacctctctgggccttggtgtcgtccatggaggcaactgtgatgaggctcagaaagggcaaatccctcaggcctcccatcagtgggcactggccatcttctggtgccaggaactttgtctctaatggcttttgccacaaccagagaggctgctctgcttggctggaagtgccaggggaataactctctggaagtagccctcaatgactgacagtgcaagtggatacatacctcggttccctcactgaccgatggacgagtctgggcaagcgtcctagcccagctcctggtggccccagtgggactgagatcacagtgtcaccaccggatgaacacccccttccttgctgccctcccttccctgcctcttgcctgtgtcccagcctgggttcttccacacaaaccacttgccctggaagccctgtctcacaaacatccatgcaaaggctgtggcagagcccctgggcaccaggcgtctggcctctggggcacagacctgtgagcagctgctgtttgtcgtgctcccactcagacaggcactgctcatcctcctccgcctgtcgccgccgtgccccctgctcctgtttcagcgcctgctccagcttgcccgcctgcttcctcaggccatccttctgcccttcagcctcctccagctgggccctgagggcctccacatgcttactgaggcgcgtcaggtctttcctctgctctgctgcccagcggcccacggtggcagccggcagtggcctgagccccatgctgtcctgcaccagttgctggaactggcctaaggacgagggcaggttctggctctgacacaggctgatgaccaccttgcccaccttctgcaggcttccctggacgctggcgcatgcgtcacagggcaccagggccgtctcaatggtctgggagtggacactcctggtgttcttgaaggtcgtggctgggaactgcagggaggctctgacagggatgctctctggctcttggcaggtctggggcaagcctagcactggggaggagggcttgattaacttggtagtcagatattcagggctcctggctggctcgcccttggtggtgggcttggaggtgggagtctccctttggtttgcccctttctgtgttcagaaaaagacaagggaaagcaggtgagggagagagtagagagggaggtgactggttccctgggggatgttctgtgacagtgtgacagccttgcctgacactcagaccctcaaatgttctctgacaccgacgtgaataagagagaactttctccctctgttactctgactcagcttactacagccaggtctcctctctgcggcccgcaccccaagctccaggcttgatctgattgtatgcatggtgttgggaaggtgatggtgacggtcacagctgctggttactgggctcttgcttactggacctgcctgctcttgtgtcaccataaccactctcagttttagtttccttcccatcatgggaacagtggttcttccccagtgggtggttgtgtggattacgggatagcccataacaaacaggggtcacatgacctccgttgtatagatgaagaaactgcggttcaaagtaggcaagatttttccaaagtcccacagggatgtcagagccagggagcaaggcatgatccccaaggcctgcgttcttaaccgccacactgtgtggggcttgattgggagggcggtgggagccagtaaaggctgtggtgcacatagtggtaggctaggaagccagagctggggcgaggtgtgaaggccaccacagtggggagatagaggctgaggctgacccacctgagacagaggctgggacccacctgggggagtggctgctggtggagcgtgcccagcctcagcaggctgtcccagaagcgccgcaccgtgagccccacggacatgcagggccccgcagcctgtgcagggggcatcatctgctctgagccaaggttctccaagtagctcatacagctttgaagcagcagcaggagcctgcgggcagagatgctaggttgctggggcccaggctggtgctaacataccctcagaccatacaaccgcagctctggctctggggaactggcccaggcatcaagagcttggagagtctcagaatatgctctgctgggccagcttcaaacctaacccaggggctacttcctcagggaagccctccctggccacagcctcagcttgggagcctcttctgtgtctcctgggtggcacttctgcctggctcttctccactggaccagggagctctgtgaagccaggcctggccttgcctcagttgtatcctgagtccttgaaaagttctgggtgaatggctgccttatatccagtggcccggagcctccacttgatagatgacagagctgagacccagagaggggaagagcttgcccacagacacacattgatagggcagagcagggagtgtgcacagtctcctgaggctagtcaggggcttctgcagggtgagctgcttctgtgacagtggagacctgtgtcaagacagctaggtctctgtcctaacctccaagtttaaaactacagtcaggcatgaattgtaagaaaaaggagtattataataaaaagctaagtttgcatttg

SEQ ID NO: 177418 - DNA, 3104 bp, Homo sapiens
  Payload ID: 14816
  Gene Symbol: RNF216
  Gene Name: ring finger protein 216
  ENST ID: ENST00000389900
  CDS Start-End: 70-1050
ttcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacgagatgctcaatatttgttgaagcaatgaagaatggatctgtaaaatggggacagagaaccagatctctcaagacctttctagacctcatcttctatgtagacagatgaatctgggaactagtgttgaatttgaagacacacacagacctgcttcacagcccttttctagtctttagtcattttattatactttttgccatctgtcttgtattgccatttgaaaccattctagtgaatgaaatataaattatgttcttatttgtttctaggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaa

SEQ ID NO: 177419 - DNA, 3293 bp, Homo sapiens
  Payload ID: 14816
  Gene Symbol: RNF216
  Gene Name: ring finger protein 216
  Uniprot ID: Q9NWF9
  ENST ID: ENST00000389902
  CDS Start-End: 269-3040
agtacccggagtgcctctatggttcttcctgtccttagtcgggagggggcgctgtgcgcaggcgcgaggtgacgccgcggcagggccggaaggagtgcagcggctgccacggagctcgcagctgcggcttctgaggagtaagcggcgcggtagcgaaggccgccgaacctgcctggctagccggcgacttgagtgacgattcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaaacaaataaacctcagagatcacgacccaatctcatcaaaccagctgcccagtggcaagatctgaaaaggttgggagaagaaaggcctaaaaagtctagagcagcatttgaatcagataagagcagctatttttcagtgtgtaacaacccattgtttgattctggggcacaggatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatccccca

SEQ ID NO: 177420 - DNA, 570 bp, Homo sapiens
  Payload ID: 14816
  Gene Symbol: RNF216
  Gene Name: ring finger protein 216
  ENST ID: ENST00000416985
  CDS Start-End: 512-570
agctgcggcttctgaggagtaagcggcgcggtagcgaaggccgccgaacctgcctggctagccggcgacttgagtgacgacatcaccatcctgtggtcacctgatctcagcgtctaggtcaactttgattcctttcttcttgccctgatggccagtgacatacacagatcccatcgactctaactctgcagtcagtgtcttgtattcttctcctccccctaggccatgtttcctgactctggttctatggccatggtgaataacagctccagtctttgacagaggaagaagtttttggagccactcgttcaacaactgtgctaggcattggaaatacaactataagtaagaaaagaggccaggcacagtgacttacgactgtaatctcaccactttgcctctggaacaggacccaaggacattatcattatacagctatctgttcttttgaaacagatggtcaccatgtttagatattagcagtcccatatatgcatgtctgcatttgaaaatggaagagggaaacaacaatgaagaggtaattcacttgaacaactttcactgccatcg

SEQ ID NO: 177421 - DNA, 5639 bp, Homo sapiens
  Payload ID: 14816
  Gene Symbol: RNF216
  Gene Name: ring finger protein 216
  Uniprot ID: Q9NWF9
  ENST ID: ENST00000425013
  CDS Start-End: 226-2826
agggggcgctgtgcgcaggcgcgaggtgacgccgcggcagggccggaaggagtgcagcggctgccacggagctcgcagctgcggcttctgaggagtaagcggcgcggtagcgaaggccgccgaacctgcctggctagccggcgacttgagtgacgattcttttgaaacagatggtcaccatgtttagatattagcagtcccatatatgcatgtctgcatttgaaaatggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacggaagcaagatttccagatgtagcaaatgggtttattgaggaaataattcattttaagaattattatgatctgaatgtactttgtaattttcttctggaaaacccagattatccaaagagagaagacagaatcattataaatcccagtagcagtctgctggccagccaagatgagacaaagttgcctaaaatagacttttttgactattctaaattgacccctcttgaccagcgctgcttcatccaagctgctgacctcctcatggccgacttcaaagtgctcagtagtcaggacatcaagtgggccctgcacgagctcaaaggacactatgcaatcacccgaaaggccttgtctgatgccattaaaaaatggcaggagctgtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcagtgcgcagatgctcacttgttctgcaaagagtgtctcatcagatatgcccaagaggcagtctttggatctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcccctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctgccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaagatctaagatggcccggcgcggtggctcccgcctgtaatcccagcactttgggaggccgaggcgggcggatgagttgaggtcgggagtttgagtccccgtctctactaaaaatacaaaattagccggacaaggtggcgcatgcctataatcccaggtactcaggaggctgaggcaggagaatcacttgaacctgggaggcagaggttgcagtgagccaagattgtgccactgcactccagcctgagcaacaaaagcaaaactctatctttaaaaaaaaaaaaaaaaaaactaagatacccattctttctgcctttgcccaggatggaggctttgaagacaggtggtcacctggacctggggtaagggtgcgcagggaggccgggcttgggggcagcctgctgctatgtccttgctggcgcccatacctgttggactgcctgaactttgctactagcctgaacgacagtgccttggaaaggcaggctccatgcggcagcaacaggattgtcttcggtaccttaaatatgctccctgtgcttccccagggaggatctctgggagcagagggcggctgtagacatcacagctgaagaggtgacctcaggccctgggagcctcagctccctctgccctgtaccctaggcacgtggctccagcaagagccccaggcaggacaaagggagcaggcagcagctgcagaaacagccctagacaggtgctggcctcaaccctggcaggggagggggagcccagagtgatgtttctcctaaggccaaaccccaggggtgggtcatttgagaggagttccagctgttctggccacactgggctggtggggaaggagcggcggcctctttccttggagggtccctgattcctgaggatcctccccgagccaggcacgggggaccacagggctgccgtgagcacccaccctggttctccaggcccctctgtccagaggcagggcctgaacctcgggctcctgcctggaccagtgacagcattggggagagaagcactgggggtcttcagaccagccagcaaggggccgtgccagtgcccagagagcaggtcagacaacaggcaaccctgaggcagctggctccctctctctgccctgcagggcttgccgcagggcgtgaggctccccagccacagccccctcttacttgccttaaaactggagagaggaatctagtatttgcacttagcaaaatatttaaaaactgaaaaaaatgtgcatgatctgtcactttgtataaaaacaagaaacgattagttcattaaactttttctttaccttctggtagtaaaaatagataaaataattccgtttcaactactgtgtgtaaaaagcctgtatcatatgtaactgggacttttgtaaataaatgtttgtgcgctctgctc

SEQ ID NO: 177422 - DNA, 563 bp, Homo sapiens
  Payload ID: 14816
  Gene Symbol: RNF216
  Gene Name: ring finger protein 216
  ENST ID: ENST00000411812
  CDS Start-End: 176-325
agtgcagcggctgccacggagctcgcagctgcggcttctgaggagtaagcggcgcggtagcgaaggccgccgaacctgcctggctagccggcgacttgagtgacgattcttttgaaacagatggtcaccatgtttagatattagcagtcccatatatgcatgtctgcatttgaaaatggaagagggaaacaacaatgaagaggtaattcacttgaacaactttcactgccatcggggacaagatggaattttactcattgcccaggccagagtgcaatggcgtaatctcgactcaccacgagctccgcctcctgggttcaaatgattctccggtctgagcctcctgagtagctgggattacagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcact

SEQ ID NO: 177423 - DNA, 1784 bp, Homo sapiens
  Payload ID: 14817
  Gene Symbol: RNF217
  Gene Name: ring finger protein 217
  Uniprot ID: Q8TC41
  ENST ID: ENST00000359704
  CDS Start-End: 339-1166
agtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtgtccattgccagcacttgagtaaagataaagagtaggagaatcaaagctgttgtataattagttctcttctcatccacacccataaaccagttcaagaaagggatgaaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcgttgaggaaattaagacttactggaacctcataagtggtagaaccaggaatcaaacccaacatttggctccacagcctgtgttgttaagtgatatgctatactgcctgaaacaagtgtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaata

SEQ ID NO: 177424 - DNA, 1771 bp, Homo sapiens
  Payload ID: 14817
  Gene Symbol: RNF217
  Gene Name: ring finger protein 217
  ENST ID: ENST00000368414
  CDS Start-End: 672-986
atttagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtgtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggc

SEQ ID NO: 177425 - DNA, 672 bp, Homo sapiens
  Payload ID: 14817
  Gene Symbol: RNF217
  Gene Name: ring finger protein 217
  ENST ID: ENST00000432158
  CDS Start-End: 1-196
agactccatcaagtataagtacttcttggaacttggccgtattgattccagcaccaagccatgtcctcagtgcaagcactttacaaccttcaagaaaaaaggacatattcccaccccttccagatcagaaagcaaatacaaacaaaatggcaggatgaagtggtttcaaaggctgtttggagtcatctccatttaaggtaaggagagcactgacatggataccccagccaaccaatcgtgagattcatggccacagtatggcaccctgtactgagactaagatctttgttctttgtgatgaacagatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtg

SEQ ID NO: 177426 - DNA, 450 bp, Homo sapiens
  Payload ID: 14817
  Gene Symbol: RNF217
  Gene Name: ring finger protein 217
  ENST ID: ENST00000519799
  CDS Start-End: 322-327
atttagtatacagaggaggacacaaacatgagaagattaaggtagagagtgaaatatggtcaggacaaatgtgaatttagagcctgagtgatggtttagtggatttatgtcctcacttgtcactaatgaaaaggaccttacaggttatataattaaagctctgttgacattggctcttgaaggcaaacttcataatgaggggaagagtcaagttttgtgtaacctgaagcatatacagtctcctgcaaatgataagaggcttgaggatacttcccaggaactcctgcctttttggaggtgactctgtcagttaaagtgtgaatgaagagtggagcataaaagtccattgccagcacttgagtaaagataaagagtaggagaatcaaagctgttgtataattagttctcttctcatccacacccataaaccagttcaagaaagggatgaag

SEQ ID NO: 177427 - DNA, 11325 bp, Homo sapiens
  Payload ID: 14817
  Gene Symbol: RNF217
  Gene Name: ring finger protein 217
  Uniprot ID: Q8TC41
  ENST ID: ENST00000521654
  CDS Start-End: 1-1629
atgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccgttctccatgcccagcctgttgggagctccaccctactctggcctgggcggtgtaggggatccctatgtgcccctcatggtgctgatgtgccgggtgtgcctggaagacaagcccatcaagcccctgccttgctgcaagaaggccgtgtgcgaggagtgcctcaaagtctacctgagcgcccaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcgatactgaacttttctatttcttgctctttctttttgtcacacaaacacagaaatttgtgcaacgtcaccccaaggagtattaagctttgtaaactgacaaaactggctgcttttaggaaattctcaagacacaaatattcagtctttttaaaattcttacattttggaaaacatgcttcactctatagatagatccttcacattgggattatttaatcccaaaaacaagtttgctgtagacaactgcttaagcctttaaaaaattcctattctgctaattttttaaccaacttgtaattatagataattctgctttaggtcaaggtcttacatcatttaatatcctaaccttgttatctcttgcctcctcctctctgtttttatttgttttcaaggtttttcataaaaacaaatactagttttgaaggattttttcttacatttaactgctcaaacataatatttttggggacaccttcttatggaggagtttgaaaactttttatgttcttgagtttgtccaatatcagctgcttttgggaaaggaaacaaaaaagtgaaggaaatattttcaggaagtttttctcaacctacaaaagctttaaaaataagaaattgacaagtaactagactatgatatgcctttgctttcatcacaaaagttcatcagcaaacaggaaaaaaaaagacccctaaaaagcctaaagctttaaattgtctccaaattcttaaaattagtcatctgtcttagatgtacatttatttgtcagcaaccttgtctgatttgaaatagatgatatgataaaacatgcattaacatgagtagtttatttttgttgggctccagagtgtaagaatattttattttttgtttgacataaaaagtgaagttgacttgcgtgaataacaatccagcatgctttcattctttctgaataacacagaataactgtgctacagcttctggattagttgtctatttccagttagaggagtgtgtgacatttatggtttgggaatagcatatttctaaagcataatataatacaagaaatagtgatgctctgttttcacaaatttatcttttcattcacccatccatccatttaacagatatttattgagtgcctatcttaggtgtaatagtatttaagactgaaagaaggagaatttctaacctgtcataagagtaaggtttcgtaaattcatctttcctgaacttaggcattagtttggcaatatgtgaatatgatgaactctaaacctagctgatctgtatatgtatgatgtatatatgtcatatgtatgatatatatgaaatattcccataactgcatatgaacacatatgccatatacatatataccaacgggctgaataacatactcttttgtcttggataatctgttttctgggttatgtatctgttgtctttggcctactcagggatttttatttctttaaataacttatcttttggacatatttttatattatttggaaaactttccaatattcctgttacaaagtggtgtctgttttcagtgatggctatttcatcagtgcttgaaatagtgtgcactgtgttgcacaggtttttcatttttctattgagtagatatttttaaattaacatacacatttttctctttaaagggtcatatctattaggcctttccctgctggtaacttaaaatgattatttgtgaattttttactaagtttcatcaagatcttaaaaagagagaagaaaataaaaagtattatttatatgtcagtgccaactttgaaggtaaaacagtagtagtaacttttgggagaaattctaaaaactactttaaaaagaagcgtgcacataaaataaatatctttctatccaaggcttgtcattttatatgcttttattgtaaatttaatatatactactttaaaaaattgaactatacagaatttataaaatacaactttctctacttaccccacctcttattttctaggggtaaccactgttaatggtttggtatgtgtccttccagacactttctacaaatatacaaataagtgtgtttgtgtatgtgtctgtgtgtgtattcattttatacaaatagaaaaatattcttactgtgctgtgactctttgtcattttattatatattaatagatacctttccataagcgtttaaatagatttacctcattcttttataaattactgcataatccattgtaggagtatactttaacttattgaattagtcccctgttgaatggactacaagattattttcacttctctattacaaagaaagcaagagtgaagacccttttgcatatatttttgtcaccttgcatgaacatatccataaggttgtacatttgttttttacaagatctttgtaataaacattttaatgtaatttcaggagatgaggtcatagagataatatgagacccttttttggataaaaagaaagattgtacaggagtgcataatttttaaagaaaatcgtcttttgaagggtaatttcctttctgcctgattagccaaataaataccttgccaaaacttacaataggaaattttttttcaataaaaataaaatttgaggagatgtgtgtcagataatgtgagagagatgaattgacttttggattgcctcattttaaaacttgagggatttaaatcaaatacccaagccaaattggtgatacttttcgcatttttagtaacactatccacttttgtgtatgttgcttgacagaggaacttaattatgccattgtgaaaagtaggaaagaatatgttggcaattataaatgcccacagcaattcccagaaaaatacattagattatgtacgatttagtgatttggtgggataattataaatcgtggaataatttatatatgtggagtaagaagagaggggtcaaaccttttggtacaagcaacatcttgttgccaccaccttgattttctcataggtgctattgtgtcctaagagtagaacagacaagaaaacaaagataattaaacacaagtcaggttacaacatgatatctttaattgtactttctctgctgtggtatcaagattcagtggtgcttgtcagaaaataccttgttctgtgactctgactatctcttgagtcccaaggctccaattgagcctttatctttcaaccttaccacccaagtatatgaccaactgttctcctaaaatacctatgaaccactgtaatcatttccagtccctgatgcccctcttcaacctcatttttctccatacctctgctattctaactattcctcttcactgaaggagaagaggagagacaggaggggcctaaaaactcactctggtatgtgggaaacattagaattccttcctgacctttgtcaaatgagggcacatctgccaagacatcagtccagcttctcccttgttaaatgaaattgtttttaacattacacttttatactggctgttacattagaattacaaaaaagttagtggcctctataaccttaattggcatactttactacaaaaataagaaaatgtatgccaaaaaacgtttttagattttaattttataagcaacctgcacataagccttaatgtgagtcttcacattggattatatttttattctcccatatttgtggctgaaatctctcccaactattgagagtgatctttcccatggtctgctttattgttttgtgttaatatctattataaatatagccttaaaattttgtaatgcactttaaaatatttgtgccatttaaataatgacaaagcaatcaatgcatacatttcaatggagacagtatacaaagttaaagcaactgatacatatatttcagtggagacagtaggataacagtgttagcaaatatgtgtcatctctttaaatttgggaggaatcagaagctaaagatttaaaacaaataaaacatacctgaagaaaagtagcaatttctgaaattgtagtaatcttggaatggttatcaaacctagcaaataatacttaataagtgttacctaatatacctaattggaatgtttgtttaaaatattaaattaatttatactgaaagttttaactgcaatttcataattcatgaattctataaaagaaatctccctcactaaaaatatgatcaatcaaaactaccagttttgcacaccaatcccaagtttaagcatattttgtatttaaagttataatttaattatgatactgtccccctaatatggaaaataagttacaaaattcttttttttttttttttttttttgagacagaggttctctcaatgttgcccaggctggtctcaaactcttgggctcaagcgatcctccctcctctgcctctggagtagctgggattacaagcacgtgcctactatgcctgtcttcaaaatcacattgttaatttttatagccacaattattaatttgataaaacaaataattttatagaagcattaaagtattatcagaacaaaatcagagttccaaaatttggggagtattttaagattgtgaaatgttaccttttggatgcaaaccaatgatacaaatctttaagaaagaattacagtgggactcctttgaaactctgattttgaaaatagaacaaatacacatttcatagccaaactttgtgtgggacttctattgttactaattgtaaggctgtaactttggttgacttcatccaaatccaagaaacagagtcacagtagtgagactattctcattgcttctttggagcattagctgaagctttaccatatcacataccttacaaaatccctatacatattgccagttttaaaagaatgtaattatgcatgttacaaactatatatatctttttggctagagaagtgactattttagaataacagtatgaatgtaaaaggcaataattttttttaaatacacaaaacattgccattgcccttttttgtcacttccttttttcttctaaaaattttcatttggtgtatctaactttgtatcacttaaattattcagacttactaagataaaaaatactttttttcagttctgtgctatattctgtcactctattccattattaatactaaatgactttccttgtgaaatgatacccacatactacaacatcaagctcctttttctcttaaatttcctaattatcttgatttttgcctctgcagtcttcttcccatcttggccaagtgtgggataaattctgtctcgcccgtaactcctttcactgtaatgaaatgaattcaacactgaacgcactccagaatttagctctggtagtgagcataatttaccttggcttattttatttgtaaatggaaatgtatcaggagtgcctggaacacttttccctcttgataggagttggagaacactgcctagccctctgccaagaagtaagtcaagcaaatgaagataccagttggatcagagggcctaataatagtctaaaaccaagcttcagaaattgcttcgtgactgttgtaagatcaatattgtgtttgcgtattagttggacagaaagcatgtgtggacattcatccaacctgaccccaggtcattcattctccatccaaaaagggttataggtatggtttatggtctttgtttcagcaaaacgtcctacagcttggacttggggtggatttatatagtgtagcatttgtatataagattcaattatggattcatgctctgtgaacattgttagatttttaataatctaaagtaggtcacattgaatgtaactgatattaaccctattctagagaaaacatttgtcatttgcaagtgtttgacttttttattgatatgatttagatatgccacactcaatatatttagtatagattcagtacataacaggaaagaaaaagggagagacagacttgagtgttaaaggaccccagaaattgctgaaatgtccttttagattcttgtggctggcaagctatgctgtcattggttctctgcgaatctgtgatgtgttcacttcgccatgccccagcttgggaaatattcttagtaatccaatcaaatccttaaaaacagcatttttgtgaatgtattacttcttcaatatccccatatatttgtattgtttcaagccactagtatctaaatttttgatataaatatctaaattctttcattttatagaaaattagcatgctttatgtttctttataatgaaaagtctagataaagtatcataatttcattatcagctgacaagaaacccttctaagacccatttttttaagtgtcatatggcaactcctcaatagcttacttttattatttgatcattttcatcacaattgcaatcctctagagggtattttaaaaagtagaccaaccttatgtttcacgtgaaacatagaataataattagtttgtatatatataaaaccatttaccttgacaaggacaatctgttacagatttttaatatgaaaattgacaattttgttgcttttagaagcaattaacatagtaattagtaaattctgagagatgacagaaatgattttctgtagaaggaacacaacagtgatgttaaaatgttaacaaagaaccagttgttttgattctattttaaacaaaattgtaaggcaattttatgaaacaaacatttatatcaatgtatatctatttcaaaactgtgggacaattattcattcttttcccaaatagagtaaaatattaaagagaaaaaaattcgagtgtttatctgttattactgtatattcagaaattacagttctaaggaattattgtcatcctctaagtatcagaatgtattccattttaattatattctccttaacaatagaaaattagaagaaatttcttgatcataagatgaatagtaatttgtaccagatcttgtccatcatttcattagattgcatatttttagttttctataaaatttgcagccattttccaaataaagtaagttataatatttttcaagtttaaaatggaccgggttgaaaagagatttcattgattctttttaatgatattggaaaatatttatgcaattttattttttaaccttttctccatttcattagttatactattaactttgataatcacaaaactatgtggaagaaatcattctgattatattttatgaaagagaggggtagagtaaattttttaattagacaatgttgatatgcagaaatctctcaaaagaaattgcaaaggaaaaattacgttgagatgaaatgttgagaaataaggagtatcttaaaaacctaatttcttacactttttagagcaatcaacttatttccaaattattatttcatgctgttgtttccatgaattgtgtttttagcatagtatatacttttctaccacgttagcatttacactctaattactgaaaataaaggaagaagttggtgaataaaagccagggaaactgggtttattctcattttccaatagcactaatgtataatccctttaaccttccatatggtgctttgtgtgatgagtatataacattcatatacgttattagtgccttatttttttcacttgactttatttcttatctaaagagccatatattttttgtgagtgttctttggtccctctatttaaagtgctaaggagaaagcatatctttagggatgtatataggctgcgtttgctaccttaatctactgtattatctctaaaacaggttagccaatgtatttttcttaaattcattgttcatttttaagctaacctatacaaatggatattaaacaccagaaattaaagccattaaaattgaattgtactttaaaaccataaaaaatgctaattaagtttagaacaggagttgaaatgactctcagttttatctatagctccaattaggacaaaattactttacaaaaagcattaaaaataaaagtaactgtatggtacttcaggaatttgaccagttccttacaacttattcttggcaatattttgtcagtaatatactttcatacagatgctagagaaccatggtgtctgctatttacatgttatttgttcccagtgagctttatcaacatcaaccctgtttatataatatgttattttgctcttcttgatctgtgccttttgttttagctttatacaaaatgctaggtttgttatattctttatgtatcataatatataattcaacttttcctgatgaatgtatgctgaataattaaactaaaccatgtgcttagaaaagacaaagacaggttgtatatgcagttatgtgtaaatatttgacaaagaaaaaaaaaggaaaagaatcttcctgccaacaggtaggtcctgctggacaggacctgaaaattaagagatttttttttttaagcagtgaaatttaaaaatctattacctcaagaattttcagtcgatatgtcaatgtactgttccttctcagtaagtacagtgtcacatgctgctggcggtaaaagcaacccaagtgtcagatcacacaaattttagggacaagtctttcaaaagacggacaccttgtgatattttggagtctaatttccgacttttcgtaatgtcccaatgaccttttgttgtggttgggcttttataaaaaattattttcggttggttgttgtagaatggaagagtaatcttaattatgaaatcagattgcatggaagaatataaagacactcactcggatgaaaactataacggttttcaaactattttgatggtcattgtacgagctattgtatggattactgtggagtgctgtttaccacatgatgtgtgcaatacatcatgcaatgttatttagcaatgcgtaataaaagtttttaaaagagaaaa

SEQ ID NO: 177428 - DNA, 10660 bp, Homo sapiens
  Payload ID: 14817
  Gene Symbol: RNF217
  Gene Name: ring finger protein 217
  ENST ID: ENST00000519565
  CDS Start-End: 1-236
atgtgcccctcatggtgctgatgtgccgggtgtgcctggaagacaagcccatcaagcccctgccttgctgcaagaaggccgtgtgcgaggagtgcctcaaagtctacctgagcgcccaggctggagtgcagtggcatgatctcggctcacggaaacctccacatcccaggttcaagcgattctcctgcctcagccttccgagtagttgggactacaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcggtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcgatactgaacttttctatttcttgctctttctttttgtcacacaaacacagaaatttgtgcaacgtcaccccaaggagtattaagctttgtaaactgacaaaactggctgcttttaggaaattctcaagacacaaatattcagtctttttaaaattcttacattttggaaaacatgcttcactctatagatagatccttcacattgggattatttaatcccaaaaacaagtttgctgtagacaactgcttaagcctttaaaaaattcctattctgctaattttttaaccaacttgtaattatagataattctgctttaggtcaaggtcttacatcatttaatatcctaaccttgttatctcttgcctcctcctctctgtttttatttgttttcaaggtttttcataaaaacaaatactagttttgaaggattttttcttacatttaactgctcaaacataatatttttggggacaccttcttatggaggagtttgaaaactttttatgttcttgagtttgtccaatatcagctgcttttgggaaaggaaacaaaaaagtgaaggaaatattttcaggaagtttttctcaacctacaaaagctttaaaaataagaaattgacaagtaactagactatgatatgcctttgctttcatcacaaaagttcatcagcaaacaggaaaaaaaaagacccctaaaaagcctaaagctttaaattgtctccaaattcttaaaattagtcatctgtcttagatgtacatttatttgtcagcaaccttgtctgatttgaaatagatgatatgataaaacatgcattaacatgagtagtttatttttgttgggctccagagtgtaagaatattttattttttgtttgacataaaaagtgaagttgacttgcgtgaataacaatccagcatgctttcattctttctgaataacacagaataactgtgctacagcttctggattagttgtctatttccagttagaggagtgtgtgacatttatggtttgggaatagcatatttctaaagcataatataatacaagaaatagtgatgctctgttttcacaaatttatcttttcattcacccatccatccatttaacagatatttattgagtgcctatcttaggtgtaatagtatttaagactgaaagaaggagaatttctaacctgtcataagagtaaggtttcgtaaattcatctttcctgaacttaggcattagtttggcaatatgtgaatatgatgaactctaaacctagctgatctgtatatgtatgatgtatatatgtcatatgtatgatatatatgaaatattcccataactgcatatgaacacatatgccatatacatatataccaacgggctgaataacatactcttttgtcttggataatctgttttctgggttatgtatctgttgtctttggcctactcagggatttttatttctttaaataacttatcttttggacatatttttatattatttggaaaactttccaatattcctgttacaaagtggtgtctgttttcagtgatggctatttcatcagtgcttgaaatagtgtgcactgtgttgcacaggtttttcatttttctattgagtagatatttttaaattaacatacacatttttctctttaaagggtcatatctattaggcctttccctgctggtaacttaaaatgattatttgtgaattttttactaagtttcatcaagatcttaaaaagagagaagaaaataaaaagtattatttatatgtcagtgccaactttgaaggtaaaacagtagtagtaacttttgggagaaattctaaaaactactttaaaaagaagcgtgcacataaaataaatatctttctatccaaggcttgtcattttatatgcttttattgtaaatttaatatatactactttaaaaaattgaactatacagaatttataaaatacaactttctctacttaccccacctcttattttctaggggtaaccactgttaatggtttggtatgtgtccttccagacactttctacaaatatacaaataagtgtgtttgtgtatgtgtctgtgtgtgtattcattttatacaaatagaaaaatattcttactgtgctgtgactctttgtcattttattatatattaatagatacctttccataagcgtttaaatagatttacctcattcttttataaattactgcataatccattgtaggagtatactttaacttattgaattagtcccctgttgaatggactacaagattattttcacttctctattacaaagaaagcaagagtgaagacccttttgcatatatttttgtcaccttgcatgaacatatccataaggttgtacatttgttttttacaagatctttgtaataaacattttaatgtaatttcaggagatgaggtcatagagataatatgagacccttttttggataaaaagaaagattgtacaggagtgcataatttttaaagaaaatcgtcttttgaagggtaatttcctttctgcctgattagccaaataaataccttgccaaaacttacaataggaaattttttttcaataaaaataaaatttgaggagatgtgtgtcagataatgtgagagagatgaattgacttttggattgcctcattttaaaacttgagggatttaaatcaaatacccaagccaaattggtgatacttttcgcatttttagtaacactatccacttttgtgtatgttgcttgacagaggaacttaattatgccattgtgaaaagtaggaaagaatatgttggcaattataaatgcccacagcaattcccagaaaaatacattagattatgtacgatttagtgatttggtgggataattataaatcgtggaataatttatatatgtggagtaagaagagaggggtcaaaccttttggtacaagcaacatcttgttgccaccaccttgattttctcataggtgctattgtgtcctaagagtagaacagacaagaaaacaaagataattaaacacaagtcaggttacaacatgatatctttaattgtactttctctgctgtggtatcaagattcagtggtgcttgtcagaaaataccttgttctgtgactctgactatctcttgagtcccaaggctccaattgagcctttatctttcaaccttaccacccaagtatatgaccaactgttctcctaaaatacctatgaaccactgtaatcatttccagtccctgatgcccctcttcaacctcatttttctccatacctctgctattctaactattcctcttcactgaaggagaagaggagagacaggaggggcctaaaaactcactctggtatgtgggaaacattagaattccttcctgacctttgtcaaatgagggcacatctgccaagacatcagtccagcttctcccttgttaaatgaaattgtttttaacattacacttttatactggctgttacattagaattacaaaaaagttagtggcctctataaccttaattggcatactttactacaaaaataagaaaatgtatgccaaaaaacgtttttagattttaattttataagcaacctgcacataagccttaatgtgagtcttcacattggattatatttttattctcccatatttgtggctgaaatctctcccaactattgagagtgatctttcccatggtctgctttattgttttgtgttaatatctattataaatatagccttaaaattttgtaatgcactttaaaatatttgtgccatttaaataatgacaaagcaatcaatgcatacatttcaatggagacagtatacaaagttaaagcaactgatacatatatttcagtggagacagtaggataacagtgttagcaaatatgtgtcatctctttaaatttgggaggaatcagaagctaaagatttaaaacaaataaaacatacctgaagaaaagtagcaatttctgaaattgtagtaatcttggaatggttatcaaacctagcaaataatacttaataagtgttacctaatatacctaattggaatgtttgtttaaaatattaaattaatttatactgaaagttttaactgcaatttcataattcatgaattctataaaagaaatctccctcactaaaaatatgatcaatcaaaactaccagttttgcacaccaatcccaagtttaagcatattttgtatttaaagttataatttaattatgatactgtccccctaatatggaaaataagttacaaaattcttttttttttttttttttttttgagacagaggttctctcaatgttgcccaggctggtctcaaactcttgggctcaagcgatcctccctcctctgcctctggagtagctgggattacaagcacgtgcctactatgcctgtcttcaaaatcacattgttaatttttatagccacaattattaatttgataaaacaaataattttatagaagcattaaagtattatcagaacaaaatcagagttccaaaatttggggagtattttaagattgtgaaatgttaccttttggatgcaaaccaatgatacaaatctttaagaaagaattacagtgggactcctttgaaactctgattttgaaaatagaacaaatacacatttcatagccaaactttgtgtgggacttctattgttactaattgtaaggctgtaactttggttgacttcatccaaatccaagaaacagagtcacagtagtgagactattctcattgcttctttggagcattagctgaagctttaccatatcacataccttacaaaatccctatacatattgccagttttaaaagaatgtaattatgcatgttacaaactatatatatctttttggctagagaagtgactattttagaataacagtatgaatgtaaaaggcaataattttttttaaatacacaaaacattgccattgcccttttttgtcacttccttttttcttctaaaaattttcatttggtgtatctaactttgtatcacttaaattattcagacttactaagataaaaaatactttttttcagttctgtgctatattctgtcactctattccattattaatactaaatgactttccttgtgaaatgatacccacatactacaacatcaagctcctttttctcttaaatttcctaattatcttgatttttgcctctgcagtcttcttcccatcttggccaagtgtgggataaattctgtctcgcccgtaactcctttcactgtaatgaaatgaattcaacactgaacgcactccagaatttagctctggtagtgagcataatttaccttggcttattttatttgtaaatggaaatgtatcaggagtgcctggaacacttttccctcttgataggagttggagaacactgcctagccctctgccaagaagtaagtcaagcaaatgaagataccagttggatcagagggcctaataatagtctaaaaccaagcttcagaaattgcttcgtgactgttgtaagatcaatattgtgtttgcgtattagttggacagaaagcatgtgtggacattcatccaacctgaccccaggtcattcattctccatccaaaaagggttataggtatggtttatggtctttgtttcagcaaaacgtcctacagcttggacttggggtggatttatatagtgtagcatttgtatataagattcaattatggattcatgctctgtgaacattgttagatttttaataatctaaagtaggtcacattgaatgtaactgatattaaccctattctagagaaaacatttgtcatttgcaagtgtttgacttttttattgatatgatttagatatgccacactcaatatatttagtatagattcagtacataacaggaaagaaaaagggagagacagacttgagtgttaaaggaccccagaaattgctgaaatgtccttttagattcttgtggctggcaagctatgctgtcattggttctctgcgaatctgtgatgtgttcacttcgccatgccccagcttgggaaatattcttagtaatccaatcaaatccttaaaaacagcatttttgtgaatgtattacttcttcaatatccccatatatttgtattgtttcaagccactagtatctaaatttttgatataaatatctaaattctttcattttatagaaaattagcatgctttatgtttctttataatgaaaagtctagataaagtatcataatttcattatcagctgacaagaaacccttctaagacccatttttttaagtgtcatatggcaactcctcaatagcttacttttattatttgatcattttcatcacaattgcaatcctctagagggtattttaaaaagtagaccaaccttatgtttcacgtgaaacatagaataataattagtttgtatatatataaaaccatttaccttgacaaggacaatctgttacagatttttaatatgaaaattgacaattttgttgcttttagaagcaattaacatagtaattagtaaattctgagagatgacagaaatgattttctgtagaaggaacacaacagtgatgttaaaatgttaacaaagaaccagttgttttgattctattttaaacaaaattgtaaggcaattttatgaaacaaacatttatatcaatgtatatctatttcaaaactgtgggacaattattcattcttttcccaaatagagtaaaatattaaagagaaaaaaattcgagtgtttatctgttattactgtatattcagaaattacagttctaaggaattattgtcatcctctaagtatcagaatgtattccattttaattatattctccttaacaatagaaaattagaagaaatttcttgatcataagatgaatagtaatttgtaccagatcttgtccatcatttcattagattgcatatttttagttttctataaaatttgcagccattttccaaataaagtaagttataatatttttcaagtttaaaatggaccgggttgaaaagagatttcattgattctttttaatgatattggaaaatatttatgcaattttattttttaaccttttctccatttcattagttatactattaactttgataatcacaaaactatgtggaagaaatcattctgattatattttatgaaagagaggggtagagtaaattttttaattagacaatgttgatatgcagaaatctctcaaaagaaattgcaaaggaaaaattacgttgagatgaaatgttgagaaataaggagtatcttaaaaacctaatttcttacactttttagagcaatcaacttatttccaaattattatttcatgctgttgtttccatgaattgtgtttttagcatagtatatacttttctaccacgttagcatttacactctaattactgaaaataaaggaagaagttggtgaataaaagccagggaaactgggtttattctcattttccaatagcactaatgtataatccctttaaccttccatatggtgctttgtgtgatgagtatataacattcatatacgttattagtgccttatttttttcacttgactttatttcttatctaaagagccatatattttttgtgagtgttctttggtccctctatttaaagtgctaaggagaaagcatatctttagggatgtatataggctgcgtttgctaccttaatctactgtattatctctaaaacaggttagccaatgtatttttcttaaattcattgttcatttttaagctaacctatacaaatggatattaaacaccagaaattaaagccattaaaattgaattgtactttaaaaccataaaaaatgctaattaagtttagaacaggagttgaaatgactctcagttttatctatagctccaattaggacaaaattactttacaaaaagcattaaaaataaaagtaactgtatggtacttcaggaatttgaccagttccttacaacttattcttggcaatattttgtcagtaatatactttcatacagatgctagagaaccatggtgtctgctatttacatgttatttgttcccagtgagctttatcaacatcaaccctgtttatataatatgttattttgctcttcttgatctgtgccttttgttttagctttatacaaaatgctaggtttgttatattctttatgtatcataatatataattcaacttttcctgatgaatgtatgctgaataattaaactaaaccatgtgcttagaaaagacaaagacaggttgtatatgcagttatgtgtaaatatttgacaaagaaaaaaaaaggaaaagaatcttcctgccaacaggtaggtcctgctggacaggacctgaaaattaagagatttttttttttaagcagtgaaatttaaaaatctattacctcaagaattttcagtcgatatgtcaatgtactgttccttctcagtaagtacagtgtcacatgctgctggcggtaaaagcaacccaagtgtcagatcacacaaattttagggacaagtctttcaaaagacggacaccttgtgatattttggagtctaatttccgacttttcgtaatgtcccaatgaccttttgttgtggttgggcttttataaaaaattattttcggttggttgttgtagaatggaagagtaatcttaattatgaaatcagattgcatggaagaatataaagacactcactcggatgaaaactataacggttttcaaactattttgatggtcattgtacgagctattgtatggattactgtggagtgctgtttaccacatgatgtgtgcaatacatcatgcaatgttatttagcaatgcgtaataaaagtttttaaaagagaaaa

SEQ ID NO: 177429 - DNA, 5145 bp, Homo sapiens
  Payload ID: 14817
  Gene Symbol: RNF217
  Gene Name: ring finger protein 217
  ENST ID: ENST00000560949
  CDS Start-End: 784-1704
atgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccgttctccatgcccagcctgttgggagctccaccctactctggcctgggcggtgtaggggatccctatgtgcccctcatggtgctgatgtgccgggtgtgcctggaagacaagcccatcaagcccctgccttgctgcaagaaggccgtgtgcgaggagtgcctcaaagtctacctgagcgcccaggtacaacttggccaagtagaaatcaaatgccccatcacagagtgttttgaattcttggaagaaacaactgttgtctataacttaacgcatgaagactccatcaagtataagtacttcttggaacttggccgtattgattccagcaccaagccatgtcctcagtgcaagcactttacaaccttcaagaaaaaaggacatattcccaccccttccagatcagaaagcaaatacaaaatccagtgccctacctgccaattcgtctggtgttttaagtgccactctccttggcatgaaggtgttaactgcaaggagtacaaaaaaggagacaaattgttgcgtcactgggccagcgaaattgagcatgggcagaggaatgcccagaagtgtccaaagtgcaagatccacatccagcgaactgaaggatgtgaccatatgacctgctcacaatgtaacactaatttttgttaccgatgtggtgagagataccgccagctccgattttttggagaccacacatcaaacctcagtatatttggatgcaaatatcgctacctcccagagagacctcatttaaggagattagtgcgagggtcagtctgtgctggaaaattattcattgcacctctaattatggttttgggattggcactaggggccatagcggttgtaatcgttgaggaaattaagacttactggaacctcataagtggtagaaccaggaatcaaacccaacatttggctccacagcctgtgttgttaagtgatatgctatactgcctgaaacaagtgtttatttgtatttcctatctattgcctttgtaaaaaacagagaaaacgatcacggacaggtatgcactggtaacatgcagatgatttcatccagctaagctggttggagtaggagcgataccaaagggtacacccatctgtgagtcacatcttgaaaaacactgagaggaaccttctaccatctcatctcccagtgattctccgtgggccacaatgcctctagctatggtgcactcccaacatggtatcctgtcctttccctaaacaaattgctgctgcttttaaaaaatggtcactttcataaactataaacatctatatcataactctgacctttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcgatactgaacttttctatttcttgctctttctttttgtcacacaaacacagaaatttgtgcaacgtcaccccaaggagtattaagctttgtaaactgacaaaactggctgcttttaggaaattctcaagacacaaatattcagtctttttaaaattcttacattttggaaaacatgcttcactctatagatagatccttcacattgggattatttaatcccaaaaacaagtttgctgtagacaactgcttaagcctttaaaaaattcctattctgctaattttttaaccaacttgtaattatagataattctgctttaggtcaaggtcttacatcatttaatatcctaaccttgttatctcttgcctcctcctctctgtttttatttgttttcaaggtttttcataaaaacaaatactagttttgaaggattttttcttacatttaactgctcaaacataatatttttggggacaccttcttatggaggagtttgaaaactttttatgttcttgagtttgtccaatatcagctgcttttgggaaaggaaacaaaaaagtgaaggaaatattttcaggaagtttttctcaacctacaaaagctttaaaaataagaaattgacaagtaactagactatgatatgcctttgctttcatcacaaaagttcatcagcaaacaggaaaaaaaaagacccctaaaaagcctaaagctttaaattgtctccaaattcttaaaattagtcatctgtcttagatgtacatttatttgtcagcaaccttgtctgatttgaaatagatgatatgataaaacatgcattaacatgagtagtttatttttgttgggctccagagtgtaagaatattttattttttgtttgacataaaaagtgaagttgacttgcgtgaataacaatccagcatgctttcattctttctgaataacacagaataactgtgctacagcttctggattagttgtctatttccagttagaggagtgtgtgacatttatggtttgggaatagcatatttctaaagcataatataatacaagaaatagtgatgctctgttttcacaaatttatcttttcattcacccatccatccatttaacagatatttattgagtgcctatcttaggtgtaatagtatttaagactgaaagaaggagaatttctaacctgtcataagagtaaggtttcgtaaattcatctttcctgaacttaggcattagtttggcaatatgtgaatatgatgaactctaaacctagctgatctgtatatgtatgatgtatatatgtcatatgtatgatatatatgaaatattcccataactgcatatgaacacatatgccatatacatatataccaacgggctgaataacatactcttttgtcttggataatctgttttctgggttatgtatctgttgtctttggcctactcagggatttttatttctttaaataacttatcttttggacatatttttatattatttggaaaactttccaatattcctgttacaaagtggtgtctgttttcagtgatggctatttcatcagtgcttgaaatagtgtgcactgtgttgcacaggtttttcatttttctattgagtagatatttttaaattaacatacacatttttctctttaaagggtcatatctattaggcctttccctgctggtaacttaaaatgattatttgtgaattttttactaagtttcatcaagatcttaaaaagagagaagaaaataaaaagtattatttatatgtcagtgccaactttgaaggtaaaacagtagtagtaacttttgggagaaattctaaaaactactttaaaaagaagcgtgcacataaaataaatatctttctatccaaggcttgtcattttatatgcttttattgtaaatttaatatatactactttaaaaaattgaactatacagaatttataaaatacaactttctctacttaccccacctcttattttctaggggtaaccactgttaatggtttggtatgtgtccttccagacactttctacaaatatacaaataagtgtgtttgtgtatgtgtctgtgtgtgtattcattttatacaaatagaaaaatattcttactgtgctgtgactctttgtcattttattatatattaatagatacctttccataagcgtttaaatagatttacctcattcttttataaattactgcataatccattgtaggagtatactttaacttattgaattagtcccctgttgaatggactacaagattattttcacttctctattacaaagaaagcaagagtgaagacccttttgcatatatttttgtcaccttgcatgaacatatccataaggttgtacatttgttttttacaagatctttgtaataaacattttaatgtaatttcaggagatgaggtcatagagataatatgagacccttttttggataaaaagaaagattgtacaggagtgcataatttttaaagaaaatcgtcttttgaagggtaatttcctttctgcctgattagccaaataaataccttgccaaaacttacaataggaaattttttttcaataaaaataaaatttgagg

SEQ ID NO: 177430 - DNA, 3529 bp, Homo sapiens
  Payload ID: 14818
  Gene Symbol: RNF219
  Gene Name: ring finger protein 219
  Uniprot ID: Q5W0B1
  ENST ID: ENST00000282003
  CDS Start-End: 60-2240
ggcgaagagtagcggtaggtcggcgggacttccgtgttggcgggattctgaacgctgccatggctcagaccgtgcagaatgttacattgtcgctcactctgcccatcacgtgccacatttgcttggggaaggtacgtcagcctgtcatatgcatcaacaaccatgtattttgttcgatttgtattgatttgtggttgaagaataatagccagtgtccagcttgcagagtccccatcactcctgaaaatccttgcaaagaaattataggaggaacaagtgaaagtgaacctatgctaagccatacggtcaggaagcatcttcggaaaactagacttgaattactacacaaagaatatgaggacgaaatagattgtttacagaaagaagtagaagagcttaagagtaaaaatctcagcttggagtcacagatcaaaactattctggatcctttaaccttggtgcagggcaaccaaaatgaagacaaacatctagtcacagataatccaagtaaaattaacccagaaactgtagcagagtggaagaaaaaactcagaacagctaatgaaatctatgaaaaagtgaaagatgatgtggataagctaaaggaggcaaataaaaaattgaaattggaaaatggtggtctggtgagggagaatttacgactgaaggctgaagttgataacagatcacctcaaaagtttggaaggtttgcagttgctgctcttcagtccaaagtagaacagtatgagcgtgaaaccaatcgcctcaagaaagccctggaacgaagtgataagtatatagaggaactagaatctcaagttgcacagctaaaaaattcaagtgaagagaaagaagctatgaattccatttgccagacagcactttctgcagatggcaaagggagcaaaggcagtgaggaggatgtggtgtcaaagaatcaaggcgatagtgccagaaagcagcctggctcatccacctccagttcttctcacctagcgaagccttccagcagcagactgtgtgacaccagttctgcaaggcaggaaagtaccagcaaagcagaccttaactgttctaagaacaaagacctatatcaagaacaggtagaagtaatgttagatgtgacagatacaagtatggatacttatttggaaagagaatgggggaataaaccaagtgactgtgtaccctacaaagatgaagaactttatgatcttccagctccttgtactcctttgtcccttagttgccttcagctcagtactccagaaaatagagagagctctgtggtccaagcaggaggttccaaaaagcactcaaaccatctcagaaaattggtgtttgatgatttttgtgattcttcaaatgtttctaataaagattcttcagaagatgatataagtagaagtgaaaatgaaaagaaatcagaatgtttttcttccccaaagacaggattttgggactgttgttccacaagctatgcccaaaacttagattttgaaagttcagaggggaacacgatagcaaattctgttggagaaatatcttcaaaattgagtgagaaatcaggcttatgtttatccaaaaggttgaattctattcgctcttttgaaatgaaccggacaagaacatccagtgaagcatcgatggatgctgcttaccttgacaaaatctctgagttggattcaatgatgtcagagtcagacaacagcaagagcccttgtaataacggttttaagtcactggatttggatgggttatcaaagtcatctcaaggcagtgaatttcttgaggaacctgataagttggaagaaaaaactgagctaaacctttccaaaggttctctaactaatgatcagttagaaaatggaagtgaatggaaacccacttctttttttctcctctctccatctgaccaagaaatgaatgaagatttttcactccattccagttcttgtccagtaactaatgaaatcaaacccccaagctgcttgtttcagacagagttttcccagggcattttgttaagcagttcacatcgactatttgaagatcaaagatttgggtcatctttgtttaagatgtcctcagagatgcacagtcttcataaccaccttcagtctccttggtctacttcctttgtgcctgaaaagaggaataaaaatgtgaatcaatcaacaaaaagaaaaatccagagcagcctttccagtgccagcccatcaaaagcaactaaaagttgactcattagaaaggtgtcatttgtggttttgtcctgagagaaatagaaaagttgttaaagttaccttttttcctcataaaagttctatacaaattggaattgataatctttagtcaagtatcaagtcaggatggtggattaacctgtacccagaatacttattgttcattttgaaaagactttgttcttttcatttttatttgggagtctttgtgaccagagaagttagggaggaggttatttttgtgttttggggttggttggttggttggttttgtttttggttttgtttttttactgaatttgatatgtatctcggttggatatacattgtttttttaaaaaatgttatttaactgttagatacagtggcctgttgataagccccacttgtcttcagaacttggatttcttaaataaaacttttagtgttgtctatacactgctcaataagacacttgagtttaagcttttcccagggtggaaattattttacctgtccctttttatttatgtttagtgatggcctagtttttctgcagggccatgatggagaaatagcactctagccttagtccaatattgatttactttctttttttaggttttatgtatatgtttgcattttttagcattgtgttttgtccagttttgtgaaaatgttctgctagtatgaaagaaaacattttctatatgaagacatttgttttatgttaggtagcttacattttctcctctgcgtgtgtgtgtatgtgtgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgttgagggggtgaagataggtaagaggtaagcacaatttttaatttaggctctgaaaaagtgtattgttctaaacgtatttggtatgcctatataggtctttaaaaatgggtatgtatgctgtttaatgtgcactgaacattttacattaatattgtactgttttacattaatactgcatgcttttctatgtgaattgaataaagaatgtcataagcactg

SEQ ID NO: 177431 - DNA, 1203 bp, Homo sapiens
  Payload ID: 14819
  Gene Symbol: RNF220
  Gene Name: ring finger protein 220
  ENST ID: ENST00000335497
  CDS Start-End: 424-1203
cgggcgatggggcggaaggagccccgcagcgggaggggtcgtggagtggggtggaaggacttcgcagccgctaaagattgggtgggtaggcttcacgggcggtgggagggaccccggggaggcttctgccggttgctacccgagtacaaacggcagcttcctggtctctgtccggccgcccccgccgcattgtgaactttcacccccagcgcgcgacggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaaacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatg

SEQ ID NO: 177432 - DNA, 3099 bp, Homo sapiens
  Payload ID: 14819
  Gene Symbol: RNF220
  Gene Name: ring finger protein 220
  Uniprot ID: Q5VTB9
  ENST ID: ENST00000355387
  CDS Start-End: 451-2151
tgcgtgcgtgtgtgtgtgcgcgcgtgtgtgtgtctccgagtccctgggagagtggaggctcattcactgattagatccagcgctgagaggcagcactgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 177433 - DNA, 3009 bp, Homo sapiens
  Payload ID: 14819
  Gene Symbol: RNF220
  Gene Name: ring finger protein 220
  Uniprot ID: Q5VTB9
  ENST ID: ENST00000361799
  CDS Start-End: 361-2061
actgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggcaagtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 177434 - DNA, 3010 bp, Homo sapiens
  Payload ID: 14819
  Gene Symbol: RNF220
  Gene Name: ring finger protein 220
  Uniprot ID: Q5VTB9
  ENST ID: ENST00000372247
  CDS Start-End: 361-2061
actgctccttctctcacgccaactgagtctcttgatctgtacatgcaatcccaggcagctcgcgaacacaaacccggggccagccgcctactgctgctgctgctgctgccgctgccgccgccgccgccgccgctgcctccgccggctctgcgaacccgggacttttcatgcaccacactctccgcctgcttccctccgtgtcctgaaaagtgcgaccgttctcccaaggaatttccacggcaagtcttaggagggaatgattccccagtaatattccctgccctgacccaaagtgctggttggcctccctcccagggaagactgcttcttgcgtaacgccggccacagaaagagactccgatggacttacaccgggcagccttcaagatggagaactcatcctaccttcccaaccctctggcatccccagcactgatggtcctggcatccacggctgaggccagccgtgatgcttccatcccttgtcagcagccacgaccctttggtgtacctgtctcagttgacaaggacgtgcatattcctttcaccaacggttcctatacctttgcctctatgtaccatcggcaaggtggggtgccaggcacttttgccaatcgtgatttccccccttctctactacacctccaccctcaatttgctcccccaaatctagattgcaccccaatcagtatgctgaatcatagtggtgtgggggctttccggccctttgcctccaccgaggaccgggagagctatcagtcagcctttacgccggccaagcgacttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatctagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttg

SEQ ID NO: 177435 - DNA, 1200 bp, Homo sapiens
  Payload ID: 14819
  Gene Symbol: RNF220
  Gene Name: ring finger protein 220
  ENST ID: ENST00000440132
  CDS Start-End: 424-1200
cgggcgatggggcggaaggagccccgcagcgggaggggtcgtggagtggggtggaaggacttcgcagccgctaaagattgggtgggtaggcttcacgggcggtgggagggaccccggggaggcttctgccggttgctacccgagtacaaacggcagcttcctggtctctgtccggccgcccccgccgcattgtgaactttcacccccagcgcgcgacggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctg

SEQ ID NO: 177436 - DNA, 361 bp, Homo sapiens
  Payload ID: 14819
  Gene Symbol: RNF220
  Gene Name: ring finger protein 220
  ENST ID: ENST00000453863
  CDS Start-End: 1-361
ggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggt

SEQ ID NO: 177437 - DNA, 860 bp, Homo sapiens
  Payload ID: 14819
  Gene Symbol: RNF220
  Gene Name: ring finger protein 220
  ENST ID: ENST00000488865
  CDS Start-End: 172-309
ccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggaagtagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggtacaagcagctgacacgtagacattggcactctggtgccaggcctctgctgggtatccatctgctggaagccaagaggccgaggctggtggctggtcatccatccgttccaccacgtggggactgctgctggtggggctcctttgtgaccgtgctgcctgcctgtgatgtgcatattaaaatggatgtatttgggtggggaaatggaattgtgaggctgcaagctaggagtgacgaaggggggctctcagcttcgggtgatgcattgaaggtgacagccaagccgcgttagcacctgcataaaatattaaagggacggttatgcatttatca

SEQ ID NO: 177438 - DNA, 2786 bp, Homo sapiens
  Payload ID: 14820
  Gene Symbol: RNF222
  Gene Name: ring finger protein 222
  Uniprot ID: A6NCQ9
  ENST ID: ENST00000344001
  CDS Start-End: 29-691
cagctgagcgtgccatctcccagtggccatgtcagaaggggagagcaaggacagctcgggcagtgagtgccccgtgtgctatgagaagttccgggacctggagggcgccagccggacgctgagctgtggccatgtgttctgccatgactgcctggtcaagtacctgctgtccacccgcgtggatgggcaggtccagaggaccctggtctgccccatctgccgctacgtcacattcctcagcaagaagagctcccgctggccctccatgctggacaagagctcccagacgctggctgtgcccgtgggcctgccctccgtgcccccactggacagcctgggccacacaaaccccctggccgcctcctcccctgcctggaggccacctccaggccaggccaggccgccaggcagcccgggccagagcgcccagctccccctggacctgctgcccagcctgccccgggagtcacagatctttgtcatcagccgccacgggatgcccctgggggagcaggacagcgtgctgccccgccgcagcctggcagagctctcggaggcctccctggcgccccgctccgcccgcgccttctgctgccgatcgcgggccctgctgctcatcacgctcatcgctgtggtggccgtggtggccgccatcctgccctgggtgctgctggtgaggaagcaggcgtgagccgcacctcagggaggccgccgggctagccgtggcctggggtgggacaggaggcccacggcagccctggtgccaccaagctccgaggggcacgcgggcaggcagaggggaggacctgggcacagagagggccttgggcttccccgacccccgcaggggcttccgctcgacagagaggctggagctgactccatgcgcgcggcgcgtgttccccacgtgaatcctcagcagatgcgttccccttcctctaggctgggaagatgggtggtcactgccctcctgcaggctcaccagccctgagcggcagaccttacctgccaggtgacctgcccaaagccaggtgggcccctccagggacaagaaagtcctgcaggcagacgtcctgctgggctggccgatggcaggatcctccaggccagaattcccacccaggatttgcggcttgccctcgggaacagacagaaggggcgcccagaatctcagcactcacccccgacctccaccacagcaccccatcccctaaccctccctgtccccaacctgccagcttagaagggcttccctgaaggagaagctgatctcagaggctgccccagaatttctgggagaatgaacagaaactgttcttcctgcagagctgaggccagatccagagacaggggttggttgatagaggccaccccagcagagtgccccacgaacggagccagaggtctccctgagccctccaggccaaaggagggatccaaactttgagtcctggggttctcaagggtggcagggagtggaggggaagcctgacaggcgagccttgagtcagctgagaactatgtgggcaaacgaacccctgggggctcccgcctccctcccagctagtcctcctcctcatgacccagccactcatttagaggccacaccagctgggccagtttcctaggtggattgccaggctgggctgggtgaggaagggtggggaggaaaacagctgtgcttgtcagggacgccgccatctcaaccgagaaatgctgaggcccaggtgccctcagctgctcctcaaggtctctttgcctggggcccccacgttggactgtgaagagcctcaggttgggtctagcctgagtcattcggggatagctattggctgtttattgaggtccgtaagtcaaccaacacctttcaatggaaaacaacaaaaacctccagcaattatctcaactaagtggtggtctgcacccagctgtgcccacagctgagcccccaacctccctcaacctatacccctctgggcaatttgctgtcttggtggggagggaagaaatagcagtctacgttttatctagttcctaaatgcctgcagtgctggtcatttggggaccgctggggaattgggccccactacaggggatatttgggacatagagagggctgctttaaaagcacttgtgggcttctctgtgctcatttcaagattacagaagtggccaggcacggtggctcatgtctgtaatcccagcactttgggaggccgaggtgggtggatcacaaggtcaggagttcgagaccagcctggccaatatggtgaaaccgcgtctctactaaaaatacaaaaattagccaggagtggtggcacgtgcctgtaatcccagctacctgggagagacagaagattcgcttgaacccgggaggcggaggttgcagtgagccgagatcgcgccactgcactccagcctgggtgacagagcgagactctgtctaaaaaaaaaaaaaaattacagaagagcacaggtgctattggaggggagggatacagatggattccatggggaaaatatttattataggaataaaaataatgttaaatttgcaaagactccaatgagtctcttttaacctcagccaggctgttttaaacagtgtcatgaatttctgggaacctggttctagtcttttcagattctgtcgtatttgccaaaagtttctttcaacatactctcagtgtttttgtatgttcaatggtgacctgtagctgcaactccttttattgtcagagaatgccaaaagctatttttaaaataaaggtatatattttctcaaa

SEQ ID NO: 177439 - DNA, 3062 bp, Homo sapiens
  Payload ID: 14820
  Gene Symbol: RNF222
  Gene Name: ring finger protein 222
  Uniprot ID: A6NCQ9
  ENST ID: ENST00000399398
  CDS Start-End: 310-972
tcattaggaattgcctcggcggtggcggtcacactaacagcaacaggaggagatcgtgctgctgctcagcacctcggggtggctcagatctgctggaggccccaggagggaaggtggatgctgctctctccgacttggctaccagtgacttctgggcatttccaaagtatcagacatattctcaaaggatgaaattctgtctccatcacggttaatcagatgcttctctcactgcctcaggcagccccataagaagaatttggagaatgactgagctgtggcagctgagcgtgccatctcccagtggccatgtcagaaggggagagcaaggacagctcgggcagtgagtgccccgtgtgctatgagaagttccgggacctggagggcgccagccggacgctgagctgtggccatgtgttctgccatgactgcctggtcaagtacctgctgtccacccgcgtggatgggcaggtccagaggaccctggtctgccccatctgccgctacgtcacattcctcagcaagaagagctcccgctggccctccatgctggacaagagctcccagacgctggctgtgcccgtgggcctgccctccgtgcccccactggacagcctgggccacacaaaccccctggccgcctcctcccctgcctggaggccacctccaggccaggccaggccgccaggcagcccgggccagagcgcccagctccccctggacctgctgcccagcctgccccgggagtcacagatctttgtcatcagccgccacgggatgcccctgggggagcaggacagcgtgctgccccgccgcagcctggcagagctctcggaggcctccctggcgccccgctccgcccgcgccttctgctgccgatcgcgggccctgctgctcatcacgctcatcgctgtggtggccgtggtggccgccatcctgccctgggtgctgctggtgaggaagcaggcgtgagccgcacctcagggaggccgccgggctagccgtggcctggggtgggacaggaggcccacggcagccctggtgccaccaagctccgaggggcacgcgggcaggcagaggggaggacctgggcacagagagggccttgggcttccccgacccccgcaggggcttccgctcgacagagaggctggagctgactccatgcgcgcggcgcgtgttccccacgtgaatcctcagcagatgcgttccccttcctctaggctgggaagatgggtggtcactgccctcctgcaggctcaccagccctgagcggcagaccttacctgccaggtgacctgcccaaagccaggtgggcccctccagggacaagaaagtcctgcaggcagacgtcctgctgggctggccgatggcaggatcctccaggccagaattcccacccaggatttgcggcttgccctcgggaacagacagaaggggcgcccagaatctcagcactcacccccgacctccaccacagcaccccatcccctaaccctccctgtccccaacctgccagcttagaagggcttccctgaaggagaagctgatctcagaggctgccccagaatttctgggagaatgaacagaaactgttcttcctgcagagctgaggccagatccagagacaggggttggttgatagaggccaccccagcagagtgccccacgaacggagccagaggtctccctgagccctccaggccaaaggagggatccaaactttgagtcctggggttctcaagggtggcagggagtggaggggaagcctgacaggcgagccttgagtcagctgagaactatgtgggcaaacgaacccctgggggctcccgcctccctcccagctagtcctcctcctcatgacccagccactcatttagaggccacaccagctgggccagtttcctaggtggattgccaggctgggctgggtgaggaagggtggggaggaaaacagctgtgcttgtcagggacgccgccatctcaaccgagaaatgctgaggcccaggtgccctcagctgctcctcaaggtctctttgcctggggcccccacgttggactgtgaagagcctcaggttgggtctagcctgagtcattcggggatagctattggctgtttattgaggtccgtaagtcaaccaacacctttcaatggaaaacaacaaaaacctccagcaattatctcaactaagtggtggtctgcacccagctgtgcccacagctgagcccccaacctccctcaacctatacccctctgggcaatttgctgtcttggtggggagggaagaaatagcagtctacgttttatctagttcctaaatgcctgcagtgctggtcatttggggaccgctggggaattgggccccactacaggggatatttgggacatagagagggctgctttaaaagcacttgtgggcttctctgtgctcatttcaagattacagaagtggccaggcacggtggctcatgtctgtaatcccagcactttgggaggccgaggtgggtggatcacaaggtcaggagttcgagaccagcctggccaatatggtgaaaccgcgtctctactaaaaatacaaaaattagccaggagtggtggcacgtgcctgtaatcccagctacctgggagagacagaagattcgcttgaacccgggaggcggaggttgcagtgagccgagatcgcgccactgcactccagcctgggtgacagagcgagactctgtctaaaaaaaaaaaaaaattacagaagagcacaggtgctattggaggggagggatacagatggattccatggggaaaatatttattataggaataaaaataatgttaaatttgcaaagactccaatgagtctcttttaacctcagccaggctgttttaaacagtgtcatgaatttctgggaacctggttctagtcttttcagattctgtcgtatttgccaaaagtttctttcaacatactctcagtgtttttgtatgttcaatggtgacctgtagctgcaactccttttattgtcagagaatgccaaaagctatttttaaaataaaggtatatattttc

SEQ ID NO: 177440 - DNA, 1902 bp, Homo sapiens
  Payload ID: 14821
  Gene Symbol: RNF223
  Gene Name: ring finger protein 223
  Uniprot ID: E7ERA6
  ENST ID: ENST00000453464
  CDS Start-End: 302-1051
agcaactcacacctgcctcagaccagagctctgtgcgggtgacggcgcacgcattccttgtgtccccgcctgtcttggacagagcagaagccacacctgccagaccagtgccaccgggacagctgctggtggccggccccggggagggatacctgctgggtgaagcacaggccgggccgggcccggagaagaggaagcagacactgccacggcagggcagcccagggccttggagcccaaccgtggccggcgaggaggaccacgcccaggcccgctgacccccggccaccagctcagagacatgtcgtcaggccagcaggtgtggcacacggctgtgccaccccctcgccggagcagctccatagcctcgatgcccaggtcccccagctcggccggcagccccaggtcccctggcacccctggctcggagagggtggcctcccccctggagtgctccatctgtttctcaggctatgacaacatcttcaagacacccaaggagctctcctgcacccacgtcttctgcctggagtgcctggcccggctggcggctgctcagcctgtgggccgccccggtggtgaggctgtaccttgccccttctgcaggcagcccacggccgtgccgcccgccggagcccccgcgctgtgcaccagccgccagctgcaggcccggatgccggcgcatttgcggcgtgaggagcctgtgtggctggagggcaccaagctgtgctgccagccactgcccaccacacctggccgcgagcccggtttcgtatgcgtggacgtgggtttgagcaagcctgccgagccgcccgcgcccgcccgggaccctgccccccgccggggccgcctggcccgctgctgggcgcgctgcagggactggaggcgcatggcactggtctctgccctgctgctgatgctcttctgtgtggcactctggccggtgcagtgcgcgctcaagaccgggaacctgcgctgcctgcccctgcccccccggcccccggccaccagcacagccgcctcccccctcgggcctctgactgataattagggccagcagcctctgcccaggtcagccgccctcgcccagctccatggggcgtcccccactggggggcccaagggcacagcagccactggaagtcggtccccgaggacgcgaaaggagcctggcatctctgaggactccaccggggccccaccaagaccaggctccatttagcttgtccacccctcattctccaggctgggtcctgacggggtggacaagaggatccccaaagcctccaagaaccacagtctcaccgggcgcggtggctcacgcctgtcatctcagcactctggagggctgaggcagaaagaccacttgaggtcgggattttgacaccagcctggccaacatggtgaaaccccatctctactaaaaatacaaaaattaaccgggcatcgtggtgggtgcctcttagctactggggaggctgaggcaggagaactgcttgaaccggggaggtggaggtggcagtgagccaagattgcaccactgcatccagcctgggcgacagagggagaccctgtctcaaaacaaaacaaaaaaaaacaggctcgtacaggaagggtccaggagagcagctggtcagcatcccccccacccacacaccctgtgaactgcctgccagggaagccccttgccaagaaggaaggggccttgccgtgcttccactcatgctgacatttccccgcagggctggtcctgccattgggtgggggtgctcatcttgccctcggactgtggggagagagtggaggcagggcagccccccagtgcaaggtaaccacagaaacttccagctacccctccaaccttgtgaattgtaccttttaaaataaattatttgtatccat

SEQ ID NO: 177441 - DNA, 1798 bp, Homo sapiens
  Payload ID: 14822
  Gene Symbol: RNF224
  Gene Name: ring finger protein 224
  Uniprot ID: P0DH78
  ENST ID: ENST00000445101
  CDS Start-End: 776-1246
cctgaccctgtgccaggacttagcgtgccaggctccccgccttgccccgttgctggcccccaccagagggtgaccacacccaggccagccacgagaacttgtctgaccagtcctgggggcagactgccaagaaggtgggcaggggtgaggaggggccatttgcttccacccagcggggctgtgagtggttctggggtcctgcccacctgtcccaacccttcttggtccctcaactctgctctgcctgcagtctggtgtggacacactgatcatacctcccggaacctgggcctcccagggtggcctggaggctgcagacgggcagagcagccaggagctgcccaccaaggaggcgtctggcactgtctggggtcccgagctgggagcggggatccccagacacggagctggtgcgccacctggagtccatgtggactggtgcagccctctgccgtccagccggcatcaaggtgaggctgagaagccacacagatccacagacaagcacagtggcaaagtctgcagaaggctctgagccaggagggaaccctggcaggcttcctagaggaggagatgtgagcagaggccaagatctagtttcaaggctttgtggctgaaacgggagcccacgcccgccacagctggccacctgcctctctcctgactcccgtgcaaggccagtaatgcaacccaggagggagccgcagggcgccctgggtcccccactcccttctccggccaccccgtggctgtgcatagctgcccagcagagcccatgcaggatgctgcagccggagggcccccaggcctcggaggaggggggcccccggaggagaggacagactgcatcatctgctgctcggcctatgacctctccgggcacctgccccgccgcctctactgtggacacaccttctgccaggcgtgtgtgcggcggctggacacaccggcgcccgagcagcgctggatcccctgtccgcagtgccgtcagagcacgcccacgcctcgcggaggggtggccatgctagacctggacctggctgctttcctggcggtcaaggctgagcgggagccggcaagactagaacccctgcccctcacctccctcaaaggcagcgccatcactcggcagccagctgggctgtgccctgccctgggaccccagccccacttcccccagcccagatactgctgctggggctgtggcagcctctgctgcccacccctaggcagccccgaggtctgaactctggccattcccacccctgcaggggaaatgcctgccttggaacccctgaccacacaccatcatgggttcagcccactcagaacaacctggcagtagcatcctatacgcagcttcgtgtggcccagcagggtggtgtcatcccagccgtgaacatcccaggccacagcctaaggttgggggctgggaggctccgcaggaggctggtgacctcccacctgtcctggccacaattaccagaccccagactagcccgaccggatgtgcctggtgaggacactgctgtctgagtgggcggcaagcctggcttgggcctagacgcagcgcaaaggatggctcccaagaggatgcgaaggcgtcccgggggcctgggctgcaggctggaggggcagggccggtctggctatgcctggcgggctgcccagagcaggtctcccctctcccacagacgtccccggggtgtaccgggagggtggcaagactacctccttcctccctgccctgcatggcagccctgtgaattcacccactcaacaaagctcatggagttcc

SEQ ID NO: 177442 - DNA, 990 bp, Homo sapiens
  Payload ID: 14823
  Gene Symbol: RNF225
  Gene Name: ring finger protein 225
  Uniprot ID: M0QZC1
  ENST ID: ENST00000601382
  CDS Start-End: 1-990
atgccctgccctcggccgttctggctccgccattcccgggccccccagggctcgggtcccagctccccaggctcgctctctgcgccccgctccccaagcagaggggaagaccaggaggaggaggaggaggaggaaggggacggcagcccaggctccggccctatcctgccccccgcctccccggtggagtgcctcatctgcgtgtcgtccttcgacggcgtgttcaagctgcccaagcgcctggactgcggccacgtcttctgtctcgagtgcctggcgcgcctatcgttggccacggcgggcggcggcaacgcggtggcctgtccggtgtgccgcgcgcccacgcgcctggccccccgccgcggactccccgcgttgcccacgcagtccggtctcctgccccgcgacgcgcgcgcaccgccctctcgccagggctccgtgcgcttcgaccggcgccgcggccttctctacctgcggccgccgccgcccccgcccgggccgcgcaaggcccgcgccccgccgcccccgccgcctctgcgcctgggccgcccgctgtcgcgccgcttgtcgctggccagcccggcctgggtcttcaacgctgccgtggcgctggcggtgctggtggccgcgggcctcgtggtctcgggcgtctacatcttcttcctcatcccgcacgccacctcctccggccccccgcggccccagctcgtggcgctcgctccagcgcctggcttctcttggtttccgccgaggcccccgccggggtcgccctgggcccccgcctggacgccgcgccccacgggccctgacctggacacggccctgccaggaactgcagaagatgcgctggagcccgaggcgggccccgaggacccggcggaggccgagaggacgctggacaggcgatcggatggcacgtggggcacagaggctggccccggctgggccccgtggccacggggcgcgaggaggctgtggggctcacaataa

SEQ ID NO: 177443 - DNA, 7453 bp, Homo sapiens
  Payload ID: 14824
  Gene Symbol: RNF24
  Gene Name: ring finger protein 24
  Uniprot ID: Q9Y225
  ENST ID: ENST00000336095
  CDS Start-End: 253-699
ctggggtttgggggaccgagccgctccgggttcgggatgctgaggagaccgcgggcccgcgccagcctcccacacacacacactctcccggcgcctcggccggccgggcgcggtgtgcaggggtgaggcggtgtctccaggctgaggagggacgcggaggagggtccggcgcggccccgggactggagggtgagtccctcacaaagggcggagcggggctgtcacctggagatcacggagggaagttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttgaaagacagtcctttttttatttattttgaaaaaggaatgagttagggacccctttataactctcttggctcagactcgaaccccatggtaaagtcaccctttccgcatctatcttcaggagttgctgggacttgttactgtgtagctgcgtggggattctggtctgctcttggaccactggctggtatcctttgtgtgtttcttaagcagctcaaagatagaatgttgctggtctgctatgggttagtggagcataactcagccccaactggactccacgggtggctgaaccattagtagttgctaggggtacaactgaattcaactgccttcagaaacagggaacaaaaccagcctgacttgattcctggttgggtcagtatcagacactaggaagttgacatctgctgcttttctttgccacgtgtgatttggttaggcctgtccctggcagataaggtccttgaagcctatgcttgcctagccagggaaggcaggacagaaatggccaaataggggcaggtggcccctgggaaggtctgagctgagggatacaggggacctcccaccattgccggataccctgttcttgacaagaagatccttttccccagtgccaagccccttggatccatcagagaaatagcctcgggccttgtcctttttcacaaccccacttcaaaatcatgtcatctccctggcctgatcccgctctaagctactttgaacaactaggaattatttttctcagaggctttttgggcattatgaaatacatcctgatacatccagggcagtatacccagagctccaggcagagagtgatggaatcacctcttgtcactcactagccttaggcccttctgcaggttagcctctcagtctcttccttagcttccttagctaccacccagggattgtagtaacgtccctggcacctcttgtgggggttagctggtgcccagagcctggtaggcagcaggcctggtgtcatgggggctgctgataccacataacatcatctgggttacatgggctcctctgccatcatgattgataggaacagaacctcagccaaaaagcttcctgagctgtaggggctttccctgaggcccaggttcacctggcccctttcttccttggtcatctctgcctttgcccacagtgaactctgacttggttgttcagtgctgaatatttctttcttaatgttttgaataggtaatccattcatgtggttcacaaatcataaagtagttaaaagcctttcttgagttcctgatgcctagcaagctccgctcctcactccatgaatacctactattggtttgttccttgggtatccttccagagatcatttatgcatgtacacacatgtgtatgtgtgtctatataatttttctccttttctactcatgtgataccagacaagtgtattcaaggaacgctcctactaatgtgggaagagccatcccagaaatcagaatacaaaatgtgaacccagaattgggggatgtttttgcaatcacactcctgttgagtaagacatattttcattttattgcaacatactgaaattttagttttctgtacaaatcagaatctgcagtccctcccttaccccaaatgcccagctaatccaagagcacaaccagatttttctgattgactttctatctgcgacaggatgctcaagatcaggctctgtagctgacagcagtggcacaggcctctcccagctctgagcagcctctgcaggtgcctggacagctgctggcccctcccctaccttggccagttccaagtgaggaccagtggtgatgtgtggctgcaactgttgtggtcacttaggcaagctcttgtgtctttgatgcaggagtttgagcagcagcaactgaaggcttctattttgtggggcagacatcttagctactgagcaagtgcacagtgagtctcatgtggatatgcctgaatgtccagcgtcagttcatggagctactccctttccctcccaacttttcgttgttgttgagacagggtcttgttacccagactggagtgcagtggcaccattgtagctcactgcagcctcaacttcctggactcaagtgatcctcccgcctcagtctgtagctgcgtctacaggtgcacaccagcacacctggctaattttcgtaattatttttttgtagagacaggtctcaactcactatgttgcccaggctggcctcctcactctgtgcacacactttgaaaagaaaatgcttctggtcgggcgcgatggctcacgcctgtaatcccaacatcccagcactttgggaggccgaggcaggcggatcaccttaggtcaagagttcaagaccagcctgaccaatatggtgaaaccccctctactaaaaatacaaaaatttgccgggtgtggtgacgcatgcctgtaatcccagccactcaggaggctgggacaggagaattgattgaacccgggagacagaagttgcagtgagccaagatccccactgcactccagcctgggcaacagagcgagactccgtctcaaaaaaacacacaagaaaagaaaatgcttcctacagaattttccctttatgccttgttttccatttgacaacagaaattaccccaacaattttttttttttttttttttttttttttttttgagacggagtctcgctctgtcacccaggctggaatgcagtggcacgatcttggcccactgcaagctccgcctcccaggttcacgccattctcccgcctcgggagctgggacaacaggtgcccgccaccacgctcggctaattttttgtatttttagtacagacggagtttcaccgtgttagccaggatggtctcgatctcctgacctcgtgatgcacctgccttgacctcccaaagtgctgggattacaggcgtgagccactgcgcccggccaataatttttttagtttaagttcatttttgtccccgctgatgaaagttagagctgcttcctccaggcagccctgggagtaggggcacagacttgtgcctcgcttcccagcagctgcccagtgcctctgtccacacccacctccctggtgtacttgccccctacagcagcagcccagatcctcccctggattaaaattgcaactggtgccctaacccaaaacttgagaaaaaattctctatcacatccactcttctggcatttgtagaatctctggccctgggtgtgtcttttcctgtagctgttacagatttcttaagcagatttcttaagcagatggacatgtccagattcatgcctaaatatccagttgataactggaaaatgctggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtcgggggagcaggtgtggcaagtgttaggaactcccttctggtgacagctggtcttcctagagtgttgctggtaactatcgcctcttggtcttctgacatcattgccaggaacggggcactttttcgtcttgtagtttggccctcgggtttcctcactaggtattgtgtaactccctcaaaaaaaggtttatgaaatgctgaacctcaggtttcatagacgtctttgtacactaaaaattctgcagcagaatatttttaaacattcgcagttttttgtaagctatatttttgtatatttaattgctattttaaaattttaatgcattttgctaatcactcctcaaaaataaaacatgcatgtaattgactcaaacgtgtaaataaaagcaaattttgaaaaata

SEQ ID NO: 177444 - DNA, 3242 bp, Homo sapiens
  Payload ID: 14824
  Gene Symbol: RNF24
  Gene Name: ring finger protein 24
  Uniprot ID: Q9Y225
  ENST ID: ENST00000358395
  CDS Start-End: 154-600
gcccctcgcgaggggccgccgggcgcagtcagccgccgccacctccgccgcgctctgtccggacggacgctcgccgcccgcagcctgccgcccgccgcagggcgctgacggtcccgcacgtctgccgctgccaccggcgcgcccgattcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttgaaa

SEQ ID NO: 177445 - DNA, 3149 bp, Homo sapiens
  Payload ID: 14824
  Gene Symbol: RNF24
  Gene Name: ring finger protein 24
  Uniprot ID: Q9Y225
  ENST ID: ENST00000432261
  CDS Start-End: 1-510
atgttgaataagagtggtgagagcagatatcctgccttgttcccggtcttagggggttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttg

SEQ ID NO: 177446 - DNA, 1128 bp, Homo sapiens
  Payload ID: 14824
  Gene Symbol: RNF24
  Gene Name: ring finger protein 24
  Uniprot ID: Q9Y225
  ENST ID: ENST00000545616
  CDS Start-End: 123-632
gccacctccgccgcgctctgtccggacggacgctcgccgcccgcagcctgccgcccgccgcagggcgctgacggtcccgcacgtctgccgctgccaccggcgcgcccgaaacttccagcactatgttgaataagagtggtgagagcagatatcctgccttgttcccggtcttagggggttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctca

SEQ ID NO: 177447 - DNA, 1914 bp, Homo sapiens
  Payload ID: 14825
  Gene Symbol: RNF25
  Gene Name: ring finger protein 25
  Uniprot ID: Q96BH1
  ENST ID: ENST00000295704
  CDS Start-End: 442-1821
agaccccctggcccgtgcgcttcgcaggccagagcccctctctcacccccagcctaggagctccaagctcctcaggccaagggacggattccctggcgtttagccccatctcttctggctgcctgcatacgttgcctgacttataattcttctccacccgcctctccctccggtctctttcggctccctttcttacaattttactcgctagaactggtgagaagttcagaggacaaaggcgctcagaggtgtggaatggacggcggaccacacatgggcacttcctgggacacatccgaactgcctcagggccatcaggcccggctaaggacccggagtctgcggttgcctagaaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagatgaactacaggtgattaaaggaaatggcagaacttcaccatgggagatctacatcactttgcatcctgccactgcagaggaccaggattcacagtatgtctgcttcactctggtgcttcaggtcccagcagagtatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatggagctgtaccagcccagtgcagagagcttgcgccagcaagaagaacgcaagcggctctaccagaggcagcaggagcgggggggaatcattgaccttgaggctgagcgaaaccgatacttcatcagccttcagcagcctcctgcccctgcggaacctgagtcagctgtagatgtctccaaaggatcccaaccacccagcacccttgcagcagaactatccacctcaccagccgtccaatccactttgccacctcctctgcctgtggcgacccagcacatatgtgagaagattccagggaccaggtcaaatcagcaaaggttgggcgaaacccagaaagctatgctagatccccccaagcccagtcgaggtccctggcgacagcccgaacggaggcacccaaagggaggggagtgccacgcccctaaaggtacccgtgacacccaggaactgccacctcctgaggggcccctcaaggagcccatggacctaaagccagaaccccatagccaaggagttgaaggtcctccacaagagaaggggcctggcagctggcaggggcccccaccccgcaggactcgggactgtgttcgctgggagcgctctaaaggccggacacccggttcttcctaccctcgcctgcctcggggccagggagcataccggcctggtactcggagggagtccctgggcctggaatctaaggatggttcctagcaggacttggtggggggaacagggaattggggatgggagggaggcaataaagatatttggccttctttggctttctttgcttagcagcgccta

SEQ ID NO: 177448 - DNA, 624 bp, Homo sapiens
  Payload ID: 14825
  Gene Symbol: RNF25
  Gene Name: ring finger protein 25
  ENST ID: ENST00000423170
  CDS Start-End: 1-477
gcggcgtctgcgtctgcagctgcaggggaggaggactgggtccttccctctgaagttgaagtattggagtccatctatctagatgaactacaggtgattaaaggaaatggcagaacttcaccatgggagatctacatcactttgcatcctgccactgcagaggaccaggattcacatatccccatgaggtgccacagatctctatccgaaatccccgaggactttcagatgaacagatccacacgatcttacaggtgctgggccacgtggccaaggctgggctgggcactgccatgctgtatgaactcattgagaaagggaaggaaattctcacagataacaacatccctcatggccagtgtgtcatctgcctctatggtttccaggagaaggaggcctttaccaaaacaccctgttaccactacttccactgccactgccttgctcggtacatccagcacatggagcaagagctgaaggcacaaggacaggagcaggaacaggaacggcagcatgctacaaccaaacagaaggcagtcggtgtgcagtgtccagtgtgcagagagcccctcgtgtatgatcttgcctcactgaaagcagcccctgaaccccaacagcccatgg

SEQ ID NO: 177449 - DNA, 2787 bp, Homo sapiens
  Payload ID: 14826
  Gene Symbol: RNF26
  Gene Name: ring finger protein 26
  Uniprot ID: Q9BY78
  ENST ID: ENST00000311413
  CDS Start-End: 597-1898
acacaagatggcggcgcccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttccttccaaattaatcccagaccccctaaaatattgacaaccttgacaaccccccaaccgaggagccagactttgttttggactaacttccatagccctatcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacggacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctctgac

SEQ ID NO: 177450 - DNA, 3627 bp, Homo sapiens
  Payload ID: 14827
  Gene Symbol: RNF31
  Gene Name: ring finger protein 31
  Uniprot ID: Q96EP0
  ENST ID: ENST00000324103
  CDS Start-End: 321-3539
attggttgggacctggccctccctcttggccgcgccccctggtttcctgacaccgctccaaccttaaccttaagccccgcccgttcctccgaaattgggtcgcagtcccaccctctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccagg

SEQ ID NO: 177451 - DNA, 579 bp, Homo sapiens
  Payload ID: 14827
  Gene Symbol: RNF31
  Gene Name: ring finger protein 31
  ENST ID: ENST00000559719
  CDS Start-End: 1-497
actgccccaaatgcaagttctcgtacgccctggcccgaggaggctgcatgcactttcactgtacccagtgccgccaccagttctgcagcggctgctacaatgccttttacgccaagaatgacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttacca

SEQ ID NO: 177452 - DNA, 2834 bp, Homo sapiens
  Payload ID: 14827
  Gene Symbol: RNF31
  Gene Name: ring finger protein 31
  ENST ID: ENST00000560787
  CDS Start-End: 1-2753
ttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttacc

SEQ ID NO: 177453 - DNA, 578 bp, Homo sapiens
  Payload ID: 14827
  Gene Symbol: RNF31
  Gene Name: ring finger protein 31
  ENST ID: ENST00000557991
  CDS Start-End: 69-578
agttgccactaggagaggcggtgctggctgggtcacagtccaggggctgcccgagggaggggctagggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaaga

SEQ ID NO: 177454 - DNA, 559 bp, Homo sapiens
  Payload ID: 14827
  Gene Symbol: RNF31
  Gene Name: ring finger protein 31
  ENST ID: ENST00000559308
  CDS Start-End: 402-559
ctttccgcccccctcctcccgctggcaggccgcaagcaccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtcc

SEQ ID NO: 177455 - DNA, 606 bp, Homo sapiens
  Payload ID: 14827
  Gene Symbol: RNF31
  Gene Name: ring finger protein 31
  ENST ID: ENST00000560754
  CDS Start-End: 198-606
cattgtctattttcctccacccgactgtcttcagatgtttacgttgcctgcctggcccctgctggcacttgaggttgttaaccctgcccagttgttaattagaccctgatttcttagtggacacctggccactgcctcttccctagcctggcagctgtggcttctgaccccctcccctccaacccctcaccctccagatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaact

SEQ ID NO: 177456 - DNA, 3198 bp, Homo sapiens
  Payload ID: 14827
  Gene Symbol: RNF31
  Gene Name: ring finger protein 31
  Uniprot ID: Q96EP0
  ENST ID: ENST00000559275
  CDS Start-End: 347-3112
aactggaagtccagggttgggccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcaggtgagatgctcctctagtcttgatggacttatgcaccagggctggggagcccagcctaactcaaaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacctgatcttgcacggggtcggtgggcctgccagagctgtacctttgagaatgaggcagctgctgtgctatgttccatatgtgagcgacctcggctggcccagcctcccagcttggtggtggattcccgagatgctggcatttgcctgcaaccccttcagcagggggatgctttgctggcctctgcccagagtcaagtctggtactgtattcactgtaccttctgcaactcgagccctggctgggtgtgtgttatgtgcaaccggactagtagccccattccagcacaacatgccccccggccctatgccagctctttggaaaagggaccccccaagcctgggcccccacgacgccttagtgcccccctgcccagttcctgtggagatcctgagaagcagcgccaagacaagatgcgggaagaaggcctccagctagtgagcatgatccgggaaggggaagccgcaggtgcctgtccagaggagatcttctcggctctgcagtactcgggcactgaggtgcctctgcagtggttgcgctcagaactgccctacgtcctggagatggtggctgagctggctggacagcaggaccctgggctgggtgccttttcctgtcaggaggcccggagagcctggctggatcgtcatggcaaccttgatgaagctgtggaggagtgtgtgaggaccaggcgaaggaaggtgcaggagctccagtctctaggctttgggcctgaggaggggtctctccaggcattgttccagcacggaggtgatgtgtcacgggccctgactgagctacagcgccaacgcctagagcccttccgccagcgcctctgggacagtggccctgagcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccaccca

SEQ ID NO: 177457 - DNA, 1804 bp, Homo sapiens
  Payload ID: 14827
  Gene Symbol: RNF31
  Gene Name: ring finger protein 31
  ENST ID: ENST00000491351
  CDS Start-End: 200-562
agtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttgtccgctgcaacgctcatggggagccccgaaactacctcaacaccctcccaccccttcctgggatgggccagacaagcagagcctggtcaggcggcttttggcagtctacgcactccccagctggggccgggcagagctggcactgtcactgctgcaggagacacccaggaactatgagttgggggatgtggtagaagctgtgaggcacagccaggaccgggccttcctgcgccgcttgcttgcccaggagtgtgccgtgtgtggctgggccctgccccacaaccggatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttaccacccag

SEQ ID NO: 177458 - DNA, 777 bp, Homo sapiens
  Payload ID: 14827
  Gene Symbol: RNF31
  Gene Name: ring finger protein 31
  ENST ID: ENST00000558907
  CDS Start-End: 1-459
ccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgggaactgagggtccccaaggaactggaggcctagaacc

SEQ ID NO: 177459 - DNA, 551 bp, Homo sapiens
  Payload ID: 14827
  Gene Symbol: RNF31
  Gene Name: ring finger protein 31
  ENST ID: ENST00000559260
  CDS Start-End: 456-551
agtacttcctgttctcggctaaccctggcgctgggccgggggctggagagtgaccgtggtctgagtgacctggggcggctgcgtgggccgggccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgc

SEQ ID NO: 177460 - DNA, 660 bp, Homo sapiens
  Payload ID: 14827
  Gene Symbol: RNF31
  Gene Name: ring finger protein 31
  ENST ID: ENST00000483895
  CDS Start-End: 1-431
gggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggagggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatg

SEQ ID NO: 177461 - DNA, 576 bp, Homo sapiens
  Payload ID: 14827
  Gene Symbol: RNF31
  Gene Name: ring finger protein 31
  ENST ID: ENST00000560071
  CDS Start-End: 395-576
agctagggccaactggaagtccagggttgggccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatgg

SEQ ID NO: 177462 - DNA, 550 bp, Homo sapiens
  Payload ID: 14827
  Gene Symbol: RNF31
  Gene Name: ring finger protein 31
  ENST ID: ENST00000560875
  CDS Start-End: 382-550
ttctttccgcccccctcctcccgctggcaggccgcaagcagtaggtagcccctcagccattcccagccagttgccactaggagaggcggtgctggctgggtcacagtccaggggctgcccgagggaggggctaggccccgcccgttcctccgaaattgggtcgcagtcccaccctctctcctagtacttcctgttctcggctaaccctggcgctgggccgggggctggagagtgaccgtggtctgagtgacctggggcggctgcgtgggccggggtgggcctcaaagccgggcaccagacgggaggggcggcgctcgggccgcgcgctgcccgcgccgggtcctggcgggcggcgaggctggggctgactcctgcctcaggatgccgggggaggaagaggagcgggccttcctggtggcccgcgaggagctggcgagcgccctgaggagggattccgggcaggcgttttccctggagcagctccggccgctactagccagctctctgccgctagccgcccgctacctgcagctggacgccgcacgccttg

SEQ ID NO: 177463 - DNA, 889 bp, Homo sapiens
  Payload ID: 14827
  Gene Symbol: RNF31
  Gene Name: ring finger protein 31
  ENST ID: ENST00000559533
  CDS Start-End: 442-889
cattcccagccagttgccactaggagaggcggtgctggctgggtcacagtccaggggctgcccgagggaggggctaggccccgaaactacctcaacaccctgtccacggctctgaacatcctggagaaatacggccgcaaccttctcagccctcagcggcctcggtactggcgtggtgtcaagtttaataaccctgtctttcgcagcacggtggatgctgtgcaggggggccgagatgtgctgcgattatatggctacacagaggagcaaccagatgggttgagcttccccgaagggcaggaggagccagatgagcaccaggttgctacagtcacactggaagtactgctgcttcggacagagctcagcctgctattgcagaatactcatccaagacagcaggcactggagcagctgttggaagacaaggttgaagatgatatgctgcagctttcagaatttgaccccctattgagagagattgctcctggccccctcaccacaccctctgtcccaggctccactcctggtccctgcttcctctgtggttctgccccaggcacactgcactgcccatcctgtaaacaggccctgtgtccagcctgtgaccacctgttccatggacacccatcccgtgctcatcacctccgccagaccctgcctggggtcctgcagggtacccacctgagccccagtttacctgcctcagcccaaccacggccccagtcgacctccctgctggccctgggagacagctctctttcttcccctaatcctgcaagtgctcatttgccctggcactgtgctgcctgtgccatgctaaatgagccttgggcagtgctctgtgtggcctgtgatcggccccgaggctgtaaggggttggggttgg

SEQ ID NO: 177464 - DNA, 808 bp, Homo sapiens
  Payload ID: 14827
  Gene Symbol: RNF31
  Gene Name: ring finger protein 31
  ENST ID: ENST00000559449
  CDS Start-End: 1-422
ccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaagtagctgagggcaagggtcccgatgagggtcccatggcctgctccctcaggaacagctccagcaccaataaagaggcatcttacc

SEQ ID NO: 177465 - DNA, 1842 bp, Homo sapiens
  Payload ID: 14828
  Gene Symbol: RNF32
  Gene Name: ring finger protein 32
  ENST ID: ENST00000311822
  CDS Start-End: 155-1087
tcggggtgagggccgtccgcggcctcgctttcgcctcctccgagccgggccggcgatggccgcagctgtgaggcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcagaatgaaacttccgcatgtttcgaagacccatgtctcggggcacatggttcgcatttcagtttaagtaactttctgctgtgatgaaactaacccgcgtggcctcttcccgtcctgtgtgccgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaa

SEQ ID NO: 177466 - DNA, 1682 bp, Homo sapiens
  Payload ID: 14828
  Gene Symbol: RNF32
  Gene Name: ring finger protein 32
  Uniprot ID: Q9H0A6
  ENST ID: ENST00000317955
  CDS Start-End: 119-1207
ggcagacgtccctgggttccggtgttcgcggaggagtcgagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaa

SEQ ID NO: 177467 - DNA, 2260 bp, Homo sapiens
  Payload ID: 14828
  Gene Symbol: RNF32
  Gene Name: ring finger protein 32
  Uniprot ID: Q9H0A6
  ENST ID: ENST00000392741
  CDS Start-End: 89-796
cgtctttgcagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagacacaagactggaaaccagcttaatttttcccatctcctgggctatatgtaaatgaagacatctgctgcacatctcatagtaatgaaaatagaagctgcctataaaaataaagcccccacatgctaccattgtattgagtacctcgtggggtcatcacaatgagctttagagctaacttccatgtctacccttcctcttaaccactatttatgctttagttttacttttgggggacttatttaacaatttcccattccttgtccccatatgaaaaggacagtcctaccccatcagcctgtggcttcaggcaaacagcagcagctccgaggctgtcatatgaaagccatcacttcttcctggcagtgttggcctgagaagagctgtagcatttataatggcccagcacacagtaggtgctggaaattctgtatttattatcactattaactcctttcctagaatatggagatgagttactgtgtgttctgttcctgagagcagtgtctctgatcttcagagatcattcgtctcgggtgttcattctcaatttggtaaaggaccgccatgcacgattgcgtcatccttcctttacattctttccagttttttatcttcagtcgttgacagtcagttgtgttctctgggctactcttagtaatttctaatatgtcatagtaggttgtctcttaaatcagaagtgattttttgtcacctcttatacaattttaattacagatttgatagtcattttaccttatatatataaatatttttcatgtgcacacatcattttataagaactcttgaagataaaggcccactgaaagtgttggtggtctcagcccattgaactggacgagaactggcccaggttgctggaaacaagtgaagcaaccattacaatgtgccttgtgttatcttgtaaagtagccagtgaaggttaagtttcagcgttcagtgctcaggtgttcaaatgctgcagccttcagcttcatggaaaaaggaaacgaaaaataacaaaaagcaagtgaccaagagcagtcggggcagggagacctgatcaaacaagttcctcagtttctaattcagtgtctcccacagagagatggaactttacaaggcagattcatagctctgtcccactggacgttgggtccgctgccctgtggccatcccacctccccacaaatactgttttttgttttatccttggttcatcccaactgctgcctcctcgtcctgagccctcatcgctcggaacgccccgctctgatccccgtgtctgcttttctgagcacactcttgcccgcccccgcatgtcctgcccgttcctactggttccctctgccttgcttaaaatgtgccagtttttcaaagcctagctgaagctttcttccaatttctttggtcttctctaaacctctattgtatgtttaaacaacaccatctaagagatcaagaagaacagaagtatgaatgctattcta

SEQ ID NO: 177468 - DNA, 1746 bp, Homo sapiens
  Payload ID: 14828
  Gene Symbol: RNF32
  Gene Name: ring finger protein 32
  Uniprot ID: Q9H0A6
  ENST ID: ENST00000392743
  CDS Start-End: 189-1277
tatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatc

SEQ ID NO: 177469 - DNA, 1748 bp, Homo sapiens
  Payload ID: 14828
  Gene Symbol: RNF32
  Gene Name: ring finger protein 32
  Uniprot ID: Q9H0A6
  ENST ID: ENST00000392747
  CDS Start-End: 78-365
cagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttgggataccattcataggatgtacagccaactttaaaccagtatgacctcatcttaactacatctgcaaagaccctatttccaaataaggtcaacatccagaggttccagcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatcaaaaaa

SEQ ID NO: 177470 - DNA, 1938 bp, Homo sapiens
  Payload ID: 14828
  Gene Symbol: RNF32
  Gene Name: ring finger protein 32
  Uniprot ID: Q9H0A6
  ENST ID: ENST00000405335
  CDS Start-End: 410-1498
gggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataa

SEQ ID NO: 177471 - DNA, 793 bp, Homo sapiens
  Payload ID: 14828
  Gene Symbol: RNF32
  Gene Name: ring finger protein 32
  ENST ID: ENST00000404282
  CDS Start-End: 131-793
ggaacgggaacgaccacagccaccgcagggaaacaaccggggcccaggcccagcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaaga

SEQ ID NO: 177472 - DNA, 308 bp, Homo sapiens
  Payload ID: 14828
  Gene Symbol: RNF32
  Gene Name: ring finger protein 32
  ENST ID: ENST00000439609
  CDS Start-End: 253-308
ggggcagggctggtgagcaagcccgcggggagcgagcgcggaggcgggcgttgctacggcaacgtatattttgaatacatctgtcttcataaaatacaccatgtccaaaatctaaaagggccaattccaaattattccaccagctttgaagggaattgaagcaagaataacaagacagaagaatagaaggaaggtgataggatgtgatgatagaatttgtgatagccaagcaacaacttttcctaattcggcatgttaaaaaataagggtcactcatctaagaaagataacttggcagtcaatgcagt

SEQ ID NO: 177473 - DNA, 1893 bp, Homo sapiens
  Payload ID: 14828
  Gene Symbol: RNF32
  Gene Name: ring finger protein 32
  Uniprot ID: Q9H0A6
  ENST ID: ENST00000432459
  CDS Start-End: 336-1424
cagggagttgcctgagggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctgcagaagaatagaaggaaggtgataggatgtgatgatagaatttgtgatagccaagcaacaacttttcctaattcggcatgttaaaaaataagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttggcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgctgctttcatgctcccatgtgttccacaaagcatgtcttcaggcttttgaaaagttcacaaataagaaaacctgtcctctctgtagaaagaaccagtatcaaacccgagtgatacacgatggggcccgcctgttcagaatcaagtgtgtgaccagaatccaagcctactggagaggatgtgttgttagaaagtggtacagaaacctgaggaaaacagtacctcccacagatgccaagttaagaaaaaaattctttgaaaaaaagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggctctgcgccgggagacccacgagtgctccatctgcctggcccctctctccgctgctggcggtcagcgcgtgggtgcaggcaggcgttccagagagatggccctcctgtcctgctcacatgtgttccaccatgcgtgtctgctggcactagaggagttctccgtgggagacaggcctcctttccatgcctgtcctctctgccgctcctgctaccagaagaagattcttgaatgttgaattcatagtcaaggaaagttaggtaattctgaggaaaaaagtttaccatcattttggatgaactgcatgagttctgggttaagtactacaatgtaatctgtttcccagggaaataagctattggtagttgtaggaaatcttagtatattttaaaagctgacatcccacctaattttaatctttggtctctaaaaagtaaatttcaaatttatgagtttaatcacttcaaatatgaatagcaaaaaatgagagcttgcttacttctaaaaattgaggttaagatatagctagtgtctgaacgacactccttaaagtaagttccaaatgtaaaacactccttaagttccaaatgttttccgctaatagtctgtcctaaagcctttgccattcctaatactcgttttgtaataattgctgtatttctgtgtaataaaatataaaaataaaatattcagtggtattcaacatc

SEQ ID NO: 177474 - DNA, 2066 bp, Homo sapiens
  Payload ID: 14829
  Gene Symbol: RNF34
  Gene Name: ring finger protein 34, E3 ubiquitin protein ligase
  Uniprot ID: Q969K3
  ENST ID: ENST00000361234
  CDS Start-End: 173-1291
gcgcttttaccggggcacgcggcgagcgtgaccacgccccttacgtccggacgctcggtcgcctcccggggcgcggtaatcaccgcccagagggaaggaggtcggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagcttt

SEQ ID NO: 177475 - DNA, 1722 bp, Homo sapiens
  Payload ID: 14829
  Gene Symbol: RNF34
  Gene Name: ring finger protein 34, E3 ubiquitin protein ligase
  ENST ID: ENST00000392464
  CDS Start-End: 70-1593
ggcagtgtgaggagctgctatggtgctgagtttcctggtagagccggccgagctgaggcggtcgcggccatgaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagaatgtcttcttgtaaaggccgccttagaaatggtccagaaagcagtgcagttacgattcagaaagaccaaaggaaagtgtcggctcactcatcccccaaacgggtggttgaacagcttctcccttggaaagacttgcaaaatggaattgcgttgtggtctgttgtcccacgttccaaatggaaaataaaagccctcatttttgtaaagtctctcccctcccagagcccgccccgtatttacatacttatccttggactaactcagtttttgcaggagtttttcttctacttgcccaaactggacactcacagacatctcggctatgaactgctcacagccttccttggtgacttgcttgcagtacctcaggtcaatatgacagatgtttccacagcgtttgaagaaggacaggcactgatcagtgaccttattgcagtctgcagagaagaaatagtaatgtgaggtgtgaaggccaggagccagaagcccccccgccgccagacccaggcactcagcagtggggacaggtcagagctctacatattccagtccctgctgtgctgcactaaataaaatgttatttgcttaaaa

SEQ ID NO: 177476 - DNA, 2051 bp, Homo sapiens
  Payload ID: 14829
  Gene Symbol: RNF34
  Gene Name: ring finger protein 34, E3 ubiquitin protein ligase
  Uniprot ID: Q969K3
  ENST ID: ENST00000392465
  CDS Start-End: 158-1279
atcaccgcccagagggaaggaggtcggcagtgtgaggagctgctatggtgctgagtttcctggtagagccggccgagctgaggcggtcgcggccatgaaggtgggggagtggtactaaggatcaagtatactgttaaaagaaaacaaaaacccaagcatgaggaaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccagacttctagcttttttacacgttcgtttttttcaaactatacagccccctctgctactatgtcttcgtttcagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagc

SEQ ID NO: 177477 - DNA, 431 bp, Homo sapiens
  Payload ID: 14829
  Gene Symbol: RNF34
  Gene Name: ring finger protein 34, E3 ubiquitin protein ligase
  ENST ID: ENST00000557402
  CDS Start-End: 319-431
gtcccagctgaaacagtgtaggcaggaagaagacatcttccctttgactgagcaggtcttaagcttttaacctggcctgtatatcagaattacccagggagttttcaaaaaaattctggtgcccaggctgcaccacagaccagtgaaatcagaacctctgggcctgggaccccaggaatcagtatttttaaagacttgcctggtgagtccaacatgcagccaaggctgaaaaccattctcttaagggcagtttcacaaccctaggcaattccttagcaagaagtactgacagcagctacgaaggcgggtgccacgtctatgtgggcttcgtgctgtgggctgctgaatgaagtcatgggaactggagctgtcaggggccagcagtcagcatttgcaggagccaccggtccattcagatttacaccaaaccc

SEQ ID NO: 177478 - DNA, 913 bp, Homo sapiens
  Payload ID: 14829
  Gene Symbol: RNF34
  Gene Name: ring finger protein 34, E3 ubiquitin protein ligase
  ENST ID: ENST00000554606
  CDS Start-End: 424-913
tcggcagtgtgaggagctgctatggtgctgagtttcctggtagagccggccgagctgaggcggtcgcggccatgaaggtgggggagtggtactaaggatcaagtatactgttaaaagaaaacaaaaacccaagcatgaggaagggattctgaaaacatattagattatacacacacagaagcaaagacagctgaaccttgaggccatttgaaaatcctggcactgtgccagaaagagagctgggctgctgctcttgcaaagaaacagaacacctttcctcttgcttttgttgactgtaatgatgtttcatgggcttatattgtttgactctgactgaggaacctgagagagtccttataaccttattggctggaaactgtcattcctactcttacgcagattatttaggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgcaagaaggatttttgctccgtttgttcagtcttacaagaaaatctccgtagatgttctacttgtcacttattacaagagacagcatttcagcgccctcagttaatgcgactgaaggtgaaggacctgcggcagtatctcattctgagaaatatacccatagatacttgtcgtgagaaagaagacttggtggatctagtactgtgccatcatggactaggctctgaggacgacatggacacaagcagtctgaattcttcaaggtcccaga

SEQ ID NO: 177479 - DNA, 593 bp, Homo sapiens
  Payload ID: 14829
  Gene Symbol: RNF34
  Gene Name: ring finger protein 34, E3 ubiquitin protein ligase
  ENST ID: ENST00000555076
  CDS Start-End: 67-204
agtgtgaggagctgctatggtgctgagtttcctggtagagccggccgagctgaggcggtcgcggccatgaagatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttcccct

SEQ ID NO: 177480 - DNA, 459 bp, Homo sapiens
  Payload ID: 14829
  Gene Symbol: RNF34
  Gene Name: ring finger protein 34, E3 ubiquitin protein ligase
  ENST ID: ENST00000554868
  CDS Start-End: 238-459
aggaatttgtggagggtgatgtcccagctgaaacagtgtaggcaggaagaagacatcttccctttgactgagcaggtcttaagcttttaacctggcctgtatatcagaattacccagggagttttcaaaaaaattctggtgcccaggctgcaccacagaccagtgaaatcagaacctctgggcctgggaccccaggaatcagtatttttaaagacttgcctggcgggtgccacgtctatgtgggcttcgtgctgtgggctgctgaatgaagtcatgggaactggagctgtcaggggccagcagtcagcatttgcaggagccaccggtccattcagatttacaccaaaccctgagttttccacctacccaccagcagctacggaagggcccaacatagtttgtaaagcctgtgggctttcattttcagtctttagaaagaagcatgtttgctgtgactgc

SEQ ID NO: 177481 - DNA, 1449 bp, Homo sapiens
  Payload ID: 14829
  Gene Symbol: RNF34
  Gene Name: ring finger protein 34, E3 ubiquitin protein ligase
  ENST ID: ENST00000613529
  CDS Start-End: 131-673
acgtccggacgctcggtcgcctcccggggcgcggtaatcaccgcccagagggaaggaggtcggcagtgtgaggagctgctatggtgctgagtttcctggtagagccggccgagctgaggcggtcgcggccatgaagggagagcttatggatggagaccaaacatccagatctggagtgccggcacaggtacaaagtgaaatcacttcagcaaacacagaagatgatgatgacgacgatgatgaggatgatgatgatgaagaagaaaacgcagaggatcggaaccccgggctctccaaggagagagtgagagcttcactgtctgacttgtcaagccttgatgatgtggaaggaatgagcgtgcgccagctgaaggaaattctggctcggaattttgtcaactattctggctgttgtgaaaaatgggaactggtagagaaagtaaaccggttatacaaagagaatgaagaaaaccaaaagtcctatggcgagcggctgcagctgcaggatgaggaagacgacagcctgtgtcgcatctgcatggatgccgtcatcgactgtgtcctactggagtgtgggcacatggttacctgcaccaagtgcggcaagcgcatgagtgagtgtcccatctgccggcagtatgtggtgcgagccgtgcacgtgttcaagtcctgaaacaggctcccctcaccaggacagtcacccccaaacttgacccccaacatttcaatgcacagaagggactggaaagttatgttcaaaggctgaagctattttaaaacattattttgactactaagtggggacagaaagatccatcctgagttgtggaaacattggtccatgccgtgagcctgtctgcctgtggacacgtgagcttcccgggctcagctgggctttatcacacatcccgtgaacactcattgaagtcagcctgtttgcgccatgtgggcatcagccactgctgtcttgggaggacacttatcctgttctcttatttccccttcatcctatttttaacttaaactgctcagatgtttgaaacttctgtcctctttggatgagatcagtgtccacaagtggccgacatggaacatgctgagcagtggctcctctgaatgttcactttattagtcatgtatattttaaatgctaacatttgatgaatgtaagtttccacattgttgctgtttctgcatttaaacataattgggaacaactgacattctctagtcgactgccagggccttagactccacatgtccatttttgttcaggtatagctttttatagcaagggctgcatctagcttcttttattagaagtgtgtgtgctaaattccttattaatgtgtaatcagtttacattgttttgtatagtgaaggtgtattttcagtgctacccgctagctgattttaactttaggaataaaattagttttaaaagctttt

SEQ ID NO: 177482 - DNA, 5012 bp, Homo sapiens
  Payload ID: 14830
  Gene Symbol: RNF38
  Gene Name: ring finger protein 38
  Uniprot ID: Q9H0F5
  ENST ID: ENST00000259605
  CDS Start-End: 109-1656
gcaagttcttcctttcagggttgaagcgtgagagaggttggtttttgaaacgggagtgtttcaggttattgaggtccaaaaagaaataaagtttttgtttacgtctgtatggcttgtaagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatc

SEQ ID NO: 177483 - DNA, 4945 bp, Homo sapiens
  Payload ID: 14830
  Gene Symbol: RNF38
  Gene Name: ring finger protein 38
  Uniprot ID: Q9H0F5
  ENST ID: ENST00000353739
  CDS Start-End: 192-1589
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaacatc

SEQ ID NO: 177484 - DNA, 5104 bp, Homo sapiens
  Payload ID: 14830
  Gene Symbol: RNF38
  Gene Name: ring finger protein 38
  Uniprot ID: Q9H0F5
  ENST ID: ENST00000350199
  CDS Start-End: 458-1756
gcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacactt

SEQ ID NO: 177485 - DNA, 5254 bp, Homo sapiens
  Payload ID: 14830
  Gene Symbol: RNF38
  Gene Name: ring finger protein 38
  Uniprot ID: Q9H0F5
  ENST ID: ENST00000357058
  CDS Start-End: 608-1906
gcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacactt

SEQ ID NO: 177486 - DNA, 1974 bp, Homo sapiens
  Payload ID: 14830
  Gene Symbol: RNF38
  Gene Name: ring finger protein 38
  Uniprot ID: Q9H0F5
  ENST ID: ENST00000377877
  CDS Start-End: 484-1803
tgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaaggttacctataagcatattgccagattttctcccagaaacaggctgtgccaagcagatgcagtttttaacaataatctagcaggatttcagttacagagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttc

SEQ ID NO: 177487 - DNA, 4985 bp, Homo sapiens
  Payload ID: 14830
  Gene Symbol: RNF38
  Gene Name: ring finger protein 38
  Uniprot ID: Q9H0F5
  ENST ID: ENST00000377885
  CDS Start-End: 339-1637
cttccccctcggggtggaaacaaagggggttcggcgcgcggtgcggagcctgggggaaaagggaggagcgctccggtggtctggcgcgctgggctcgctagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacactt

SEQ ID NO: 177488 - DNA, 5185 bp, Homo sapiens
  Payload ID: 14830
  Gene Symbol: RNF38
  Gene Name: ring finger protein 38
  Uniprot ID: Q9H0F5
  ENST ID: ENST00000611646
  CDS Start-End: 518-1837
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaaggttacctataagcatattgccagattttctcccagaaacaggctgtgccaagcagatgcagtttttaacaataatctagcaggatttcagttacagagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcgctccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccattcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacactt

SEQ ID NO: 177489 - DNA, 2206 bp, Homo sapiens
  Payload ID: 14831
  Gene Symbol: RNF39
  Gene Name: ring finger protein 39
  Uniprot ID: Q9H2S5
  ENST ID: ENST00000244360
  CDS Start-End: 99-1361
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 177490 - DNA, 1961 bp, Homo sapiens
  Payload ID: 14831
  Gene Symbol: RNF39
  Gene Name: ring finger protein 39
  Uniprot ID: Q9H2S5
  ENST ID: ENST00000376750
  CDS Start-End: 61-1125
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccgtgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacacccaagtcatctaattcagaggatgatctccctgaagattatccagtggtcaaaaaaatgcttcatagactgacagccgacctgaccctggaccctgggaccgcacaccgccgcctgctcatctccaccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgaggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggcgtggaattccccactcatttctgggaacacattcacacgcccattgcaggagtattaatagcaacccacattttcgccccaaaataatgagacctcacctggtctccacgtttccacatccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtactcttttgcaggatctgggggtggggagggacaagctagttccccaacctcctatgactgctttctatgctcacagccttttttccataagaaccttcttgaaacttctccccgcacatacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 177491 - DNA, 1970 bp, Homo sapiens
  Payload ID: 14831
  Gene Symbol: RNF39
  Gene Name: ring finger protein 39
  Uniprot ID: Q9H2S5
  ENST ID: ENST00000376751
  CDS Start-End: 61-1125
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 177492 - DNA, 2161 bp, Homo sapiens
  Payload ID: 14831
  Gene Symbol: RNF39
  Gene Name: ring finger protein 39
  ENST ID: ENST00000383611
  CDS Start-End: 63-1325
ggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccgtgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacacccaagtcatctaattcagaggatgatctccctgaagattatccagtggtcaaaaaaatgcttcatagactgacagccgacctgaccctggaccctgggaccgcacaccgccgcctgctcatctccaccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgaggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgagcccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggcgtggaattccccactcatttctgggaacacattcacacgcccattgcaggagtattaatagcaacccacattttcgccccaaaataatgagacctcacctggtctccacgtttccacatccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtactcttttgcaggatctgggggtggggagggacaagctagttccccaacctcctatgactgctttctatgctcacagccttttttccataagaaccttcttgaaacttctccccgcacatacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggta

SEQ ID NO: 177493 - DNA, 2206 bp, Homo sapiens
  Payload ID: 14831
  Gene Symbol: RNF39
  Gene Name: ring finger protein 39
  ENST ID: ENST00000420562
  CDS Start-End: 99-1361
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggggggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 177494 - DNA, 1970 bp, Homo sapiens; identical to SEQ ID NO: 177491
  Payload ID: 14831
  Gene Symbol: RNF39
  Gene Name: ring finger protein 39
  Uniprot ID: Q9H2S5
  ENST ID: ENST00000451425
  CDS Start-End: 61-1125

SEQ ID NO: 177495 - DNA, 1970 bp, Homo sapiens
  Payload ID: 14831
  Gene Symbol: RNF39
  Gene Name: ring finger protein 39
  Uniprot ID: Q9H2S5
  ENST ID: ENST00000441449
  CDS Start-End: 61-1125
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 177496 - DNA, 2206 bp, Homo sapiens
  Payload ID: 14831
  Gene Symbol: RNF39
  Gene Name: ring finger protein 39
  Uniprot ID: Q9H2S5
  ENST ID: ENST00000425956
  CDS Start-End: 99-1361
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctgctacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 177497 - DNA, 2206 bp, Homo sapiens
  Payload ID: 14831
  Gene Symbol: RNF39
  Gene Name: ring finger protein 39
  Uniprot ID: Q9H2S5
  ENST ID: ENST00000456156
  CDS Start-End: 99-1361
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 177498 - DNA, 2206 bp, Homo sapiens; identical to SEQ ID NO: 177489
  Payload ID: 14831
  Gene Symbol: RNF39
  Gene Name: ring finger protein 39
  Uniprot ID: Q9H2S5
  ENST ID: ENST00000432647
  CDS Start-End: 99-1361

SEQ ID NO: 177499 - DNA, 1970 bp, Homo sapiens
  Payload ID: 14831
  Gene Symbol: RNF39
  Gene Name: ring finger protein 39
  Uniprot ID: Q9H2S5
  ENST ID: ENST00000442378
  CDS Start-End: 61-1125
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcgatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctgctacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatccgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 177500 - DNA, 1970 bp, Homo sapiens; identical to SEQ ID NO: 177491
  Payload ID: 14831
  Gene Symbol: RNF39
  Gene Name: ring finger protein 39
  Uniprot ID: Q9H2S5
  ENST ID: ENST00000457092
  CDS Start-End: 61-1125

SEQ ID NO: 177501 - DNA, 1970 bp, Homo sapiens
  Payload ID: 14831
  Gene Symbol: RNF39
  Gene Name: ring finger protein 39
  Uniprot ID: Q9H2S5
  ENST ID: ENST00000417541
  CDS Start-End: 61-1125
cgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 177502 - DNA, 2206 bp, Homo sapiens; identical to SEQ ID NO: 177497
  Payload ID: 14831
  Gene Symbol: RNF39
  Gene Name: ring finger protein 39
  Uniprot ID: Q9H2S5
  ENST ID: ENST00000450015
  CDS Start-End: 99-1361

SEQ ID NO: 177503 - DNA, 2206 bp, Homo sapiens
  Payload ID: 14831
  Gene Symbol: RNF39
  Gene Name: ring finger protein 39
  Uniprot ID: Q9H2S5
  ENST ID: ENST00000449145
  CDS Start-End: 99-1361
cccaaaccttacccgggaagcaggagaaccagatgaggcgttacgcaaggcctggtgtttacctcccgtgggagcctcctccctccctataaagcctgatgtggtggagagatttgacgagactgagactctggttgaagagagaggcaatcccaggagaggggcggaaagcggcaaaagttaatgcgggagtcggagagaagggcatctacacagcaagcagcaggggcggcccgccatctgcgcgctcgaaggcggtcacggtggtcgcggaaggggcggcgtccagatcctggctttccatggatgcgcccgagctgggcccggggctggtggagcgtctggagcagctggcgacgtgtcctctgtgcgggggctccttcgaggacccggtgcttctggcgtgcgagcacagcttctgccgcgcgtgtctggcccgccgctgggggactccgccggcgaccggcaccgaggcttcccccaccgcctgtccctgctgcggcctgccgtgtccccgccgcagcctgaggtctaatgtgcggctggcggtggaggtgcgaatcagccgcgagctgcgagagaagctggctgagcctggggcccgtgcggggagacgccgaggggggcgcatccccaccatgggctgcctggacctgcccggagaggatatgaggaagacatggagacgatttgaagtcccaacatccaagtcatctaattcagaggatgatctccctgaagattatccagtggtcaaaaaaatgcttcatagactgacagccgacctgaccctggaccctgggaccgcacaccgccgcctgctcatctccgccgaccgccgcagcgtacaactggccccaccagggacgcccgcgccccctgacggccccaagcgcttcaatcagctcccagctgtgctgggtgcgcagggcttcggggccggccgccactgctgggaggtggagactgcggacgccgcctcctgcagagactcttctggggaggatgcggacgacgaggagagccactatgcagtgggcgcggccggggaatcagtgcaacgcaagggctgcgtaaggctgtgccctgcgggggccgtgtgggccgtggagggccgcggcggccgcctgtgggccctcacggcacccgaacccaccctgctgggcggtgttgagcccccgccgcggcgcattcgcgtggacctggactgggagcggggccgcgtggccttctacgacggccgctcactcgacctgctttacgccttccaggcgcctggccccctgggggagcgcatcttcccgctgttctgcacctgcgaccctcgtgctccgctccgcattgtaccagcggaaagctgagtctcgtctccaactagaagtttggcccggccactggccctgcagctgctttttgggggtggaattccccactcatttctgggaacacattcacacgcccattgcaggagtattaatagcaacccacattttcgccccaaaataatgagacctcacctggtctccacgtttccacgtccctgctcaaaaccaaatccattcctgccttctggctctcagaatcttctctcccctacagctactacagtacttcctgacttctcccattcaaaccattctaggcctgcaatggggaacaggccctccccatcagtattggtaaagtgaccatgattcctacatagaggctctgctggtcaaatacttgactcccactcttgccactcctagctccagaagggctcagggccttccccacagatctaaggactgggctaccctgcctgtccactgaggtttctcctaaaacaagaggcttgactctggtctgggccctgtggccctctgggaagctttgtacctcttttgcaggatctgggggtggggagggacaagctagttccccaacctcctatgactgctttctatgctcacagccttttttccataagaaccttcttgaaacttctccccgcacatactcacggaaaggaaccaatggtgctatttcccctctctcctcctcaacctgggaatacttcagacatctccaaactcatccttgtgtatagtctcacacccttccccataagtataaatgggcccatatttaacacattttgtgattttgggttatttattttgtgcatctgtggcaataaatgagatctcagtggtggtatgga

SEQ ID NO: 177504 - DNA, 1970 bp, Homo sapiens; identical to SEQ ID NO: 177495
  Payload ID: 14831
  Gene Symbol: RNF39
  Gene Name: ring finger protein 39
  Uniprot ID: Q9H2S5
  ENST ID: ENST00000442063
  CDS Start-End: 61-1125

SEQ ID NO: 177505 - DNA, 3088 bp, Homo sapiens
  Payload ID: 14832
  Gene Symbol: RNF4
  Gene Name: ring finger protein 4
  Uniprot ID: P78317
  ENST ID: ENST00000314289
  CDS Start-End: 480-1052
agtgcgctcgattgtgggcgggggcggaaagaggcgcgttttaaagtggtaacagatggttttcttatccaataggattaaaaaatttgtccttacccggccgaccgcggaagtagagtaggcgggcggccaatggggacatgatggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaacca

SEQ ID NO: 177506 - DNA, 893 bp, Homo sapiens
  Payload ID: 14832
  Gene Symbol: RNF4
  Gene Name: ring finger protein 4
  ENST ID: ENST00000509258
  CDS Start-End: 311-580
agcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccacacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtc

SEQ ID NO: 177507 - DNA, 416 bp, Homo sapiens
  Payload ID: 14832
  Gene Symbol: RNF4
  Gene Name: ring finger protein 4
  ENST ID: ENST00000513450
  CDS Start-End: 253-416
gcttctgcttggctgcctagtccacagcctcccgattcaccattcacctggtcccagcaacagaagtctcagctggacacacaacatgctttagagacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttaga

SEQ ID NO: 177508 - DNA, 616 bp, Homo sapiens
  Payload ID: 14832
  Gene Symbol: RNF4
  Gene Name: ring finger protein 4
  ENST ID: ENST00000507247
  CDS Start-End: 312-616
aagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacggccctcaggtactgtcagttgtcccatctgcatggacggatactcagagatcgtgcagaatggacgtctcatcgtttccacagaatgcggc

SEQ ID NO: 177509 - DNA, 545 bp, Homo sapiens
  Payload ID: 14832
  Gene Symbol: RNF4
  Gene Name: ring finger protein 4
  ENST ID: ENST00000513578
  CDS Start-End: 249-392
ctttctcgaggagctctcctgggcggctgaagaaggagcttcttctccggagtgcgccggcggtggcgcctgcggacctaactagctccaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactggctggggtgcagtggcgtgatctttgcatcccggggttcaagcaattctcctgcctcagcctcccgagtagctgggattacagctggagatgaaattgtggacctcacttgtgaatctttagagcctgtggtggttgatctgactcacaatgactctgttgtggtaagtgttg

SEQ ID NO: 177510 - DNA, 855 bp, Homo sapiens
  Payload ID: 14832
  Gene Symbol: RNF4
  Gene Name: ring finger protein 4
  ENST ID: ENST00000502316
  CDS Start-End: 291-855
ggcctccgaagcggaagtgggttgctgttgaggcggcggcatctttctcgaggagctctcctgggcggctgaagaaggagcttcttctccggagtgcgccggcggtggcgcctgcggacctaactagctccaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccattt

SEQ ID NO: 177511 - DNA, 558 bp, Homo sapiens
  Payload ID: 14832
  Gene Symbol: RNF4
  Gene Name: ring finger protein 4
  ENST ID: ENST00000503659
  CDS Start-End: 544-558
tagaagtgctggagactcccccaacccctccagcccctgagcggtggtactgtctaggagcgcgccgcggcccctgggcctcgctgtctgtcctaaatcattccggtgaacctctccggctgcgtagctccttgcccccgcgtcgcttggacacgggtggcatcctgggtctggcctgggcctcccgccggcctgctcctgagcccgccgcgtcgcccgccaggtgggaggaaaagaaggcccttgcggcggccccggcggcgccctcgcaggacgagcgcgtgcagcagctgcggcgcaggatctcggagagggcggccgagcgcagcaggcaggcggccttgctgcacgtgtcggcgccgcggaccgcgcgccccaagccccgggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaag

SEQ ID NO: 177512 - DNA, 2098 bp, Homo sapiens
  Payload ID: 14832
  Gene Symbol: RNF4
  Gene Name: ring finger protein 4
  Uniprot ID: P78317
  ENST ID: ENST00000506706
  CDS Start-End: 871-1443
agaagttaggaggtctgcgtctgggtctcggctcaccctggggggccgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtggaatctcactctgtcacccaggatgcagtgcactggcgtgttctcggtctcactgtaacctctgccatctgggctcaagtgattctcctgcctcagcctccggagtagctgggattacaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagccca

SEQ ID NO: 177513 - DNA, 560 bp, Homo sapiens
  Payload ID: 14832
  Gene Symbol: RNF4
  Gene Name: ring finger protein 4
  ENST ID: ENST00000504224
  CDS Start-End: 357-560
gttgtgcggctggaaatctaggaatgggaaggttcggggcctgctcggctccggaggcagctggcgggtcgtccctggcggcgttggagcggtcagtggcagccgggcacgggcgaccgggtcgcccgggtcgccctcagaccgtgactcccgaaaaaccttgcgggcggggcgcgcccgcgccgtctcttgccggaaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtg

SEQ ID NO: 177514 - DNA, 517 bp, Homo sapiens
  Payload ID: 14832
  Gene Symbol: RNF4
  Gene Name: ring finger protein 4
  ENST ID: ENST00000513284
  CDS Start-End: 310-441
gcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgattgttgacgaaagaagaagaccaaggaggaatgctaggaggctgccccaggaccatgctgacagctgtgtggtgagcagtgac

SEQ ID NO: 177515 - DNA, 4123 bp, Homo sapiens
  Payload ID: 14832
  Gene Symbol: RNF4
  Gene Name: ring finger protein 4
  Uniprot ID: P78317
  ENST ID: ENST00000511600
  CDS Start-End: 1516-2088
tttttctctttcaaaaacactctgccatcttttcaaggtatccgccatctctttcaagcatgtgaggagcttgataacttttgttgggggtcggtgttcagaatgacaagggtcttgcccaggctggagtgcagtagcacagtcataactcactctagcctcaacctcccagggcacaagcgatcctcccatcttagcctcctgagtaactgggactacaggcacgtgccaccacaccctgctaatttttttttttctttggtattaatattttgtagagaaggagtttcaccatgttgcccaggctggtccagaactcctgggctcaagcaatcctgccttggcttcccaaagtgctgggattacaggcatgagccaccatgcctggccctagagcttgataatttcattcattcattcttttttttttttttttttgagacaaagtctcagtctgtcacccaggttggagtgcaatggcgcaatcttggctcactgcaacttctgcctcccgagttcaaggggttctcctgcctcagcctcctgagtggcagggattacagatgcccaccaccatgcctggctaatttttgtatttttagtagaggtggggtttcaccatgttggccaggttggtctcaaactcccaacctcaggtaatctgcccaccttggcctcccagagtgctgggattacaggtgtgagctcagaccttgataatttcagtgaggaaaaaaaaaaaatctcatttacatgtttgtgccaagtgctgtgctagtgggtggggacaccatgataagtatttgataagttatgtttcttgatttaagggagtatagaagaaatggttaagtcaggactaggaggagtgagagaaatggaagcaacctttgaggtaggccctgaagaacgagcagaaattccctaaagcggggtgggagcggcaggaccaacctggccaacttcggaccttctttgaggtccaaagtcaggtactttgaactgacttccaggatacctggagtaaagtacagttctgtttgaagtgtttgtttggaaagatgagtttgttccagtgaggttgctgtattagagaaccacttgagagtttgctgcccacagtgtcatctgtgagaaatattaggtgaacgcaaaaagttgaggccagctgaaccaagccatgtaatatacacaccttccacatagatcagtcacctcagttgacttgtatgtgagccacatttgtgtccatctgatgttacagcattcactctctttgcctccacttctcaataactcacaatctgtaaactgactgaggcccgcttccacagagcaagcttcaggcctttttcaaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaacc

SEQ ID NO: 177516 - DNA, 1373 bp, Homo sapiens
  Payload ID: 14832
  Gene Symbol: RNF4
  Gene Name: ring finger protein 4
  Uniprot ID: P78317
  ENST ID: ENST00000511859
  CDS Start-End: 277-618
tttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctc

SEQ ID NO: 177517 - DNA, 603 bp, Homo sapiens
  Payload ID: 14832
  Gene Symbol: RNF4
  Gene Name: ring finger protein 4
  ENST ID: ENST00000508235
  CDS Start-End: 1-320
aggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacgactccttttagttttggcatgaatcataggacaccaccctaccctgctggggattattgtcttctgtgcagaagtgaacggaaagactcatcattcttagagagtggaattaagactgcgagcaaattggccctttccatggctcccaagggcaacagcgtgctgcacctgccactgtgggtgtgcccggactgccgcaggaccgtggagaaggaggagaggcatggcggccttgaccagccagtgagccaagattttcttcttcactcctcgcttggtggctcccagccagaggccggcagtgg

SEQ ID NO: 177518 - DNA, 2796 bp, Homo sapiens
  Payload ID: 14832
  Gene Symbol: RNF4
  Gene Name: ring finger protein 4
  Uniprot ID: P78317
  ENST ID: ENST00000541204
  CDS Start-End: 349-690
aatggggacatgatggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaacc

SEQ ID NO: 177519 - DNA, 5634 bp, Homo sapiens
  Payload ID: 14833
  Gene Symbol: RNF40
  Gene Name: ring finger protein 40, E3 ubiquitin protein ligase
  Uniprot ID: O75150
  ENST ID: ENST00000324685
  CDS Start-End: 436-3441
aacgcgcagatacgtgagaagttgcgagtgcccacctgggcgccctctcttccaggttgctaatacgagggccggtgctgtcctccaggctgggaagtgggagcgcggtgtcagttactatgggaactgcctcttggccaatcaccgagagaaagaggaggtgtttgggaagaagccagaggacccgagtggcgggaccaagcgtaaccaatagaagcagaagataaagaagtttcctcacatccggggctgcctttggcgcctgcgccctgcgcaccgttggggggggggcagtggcgtccagtgacgcccagtgacgtccggtgaaatccaagatggcggcgctaggctgaccctcctgctggtgacggaagtaccgcctcctcccgtttgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaatgtagtcccccgattttagctgcagcagctgagcagcactttgctggcttggtgtgagcctgggagggctcagacttaacggccggcagggatcccggactgggcctgaaggggagagcgtggtggtcgtcgcggagccgcctgtcctgctcccaccgaccccggtctgaccacgtccttggctgtcatggccgggggatgccgggactcctcgggctgcatcctgggaagtgtagttcctggtccgcacatggttaggaggttctcggagagagagctagtttcccggttgcgctggccaaaggccggcctgaactggatcctgcggaccgcttctcagcggcttcacccccacaccactcgaatgcacagatcgggacacctcagctgggtgacttccctcgttgcaatcggcctcgggagcggtgcggcgtgtaccgagcggcgcccctgggctcagcgcgctgcaggcgccccgggcggatccttcaccgaggcaggactggggctggcgccagagccggtgcggagcggtgttggttcaggcgctggcgacagtgctatggccacggcaggggccgcgtgcgtctcagcggtggcgccttcggaccctattggcgcccgggacttaagcggggccgccgctgctggaccaggacgaactggagaaggagacgcgggccgccacggtgacctcgggcgtagggccggcggcggcgggcacgctggtggaagcgcgggccgcggcaggggaggacatcgggccgcagagaaagtgccgatggcctggggcagcggtgcgagggtgggaaaaacgcaggatattgcatcatagagacgcggccaccttcgcccctggagagcgccagtctcaggagcgccgcaccggtcacgggtggaggtcagccaggcctccgtaagcgcggtccccttccaggagtagccttcgcctgggctcttgagtagatgccaagtaattccgcatcgtctctctagatatctgcgctaaaggccacccggtctccttatcagaggggcaaaactctcctcgtgggtcttcatacctaataaaagtcggcatcaaaccac

SEQ ID NO: 177520 - DNA, 3917 bp, Homo sapiens
  Payload ID: 14833
  Gene Symbol: RNF40
  Gene Name: ring finger protein 40, E3 ubiquitin protein ligase
  Uniprot ID: O75150
  ENST ID: ENST00000357890
  CDS Start-End: 111-2816
gaaatccaagatggcggcgctaggctgaccctcctgctggtgacggaagtaccgcctcctcccgtttgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcacccc

SEQ ID NO: 177521 - DNA, 4063 bp, Homo sapiens
  Payload ID: 14833
  Gene Symbol: RNF40
  Gene Name: ring finger protein 40, E3 ubiquitin protein ligase
  ENST ID: ENST00000563683
  CDS Start-End: 111-2996
gaaatccaagatggcggcgctaggctgaccctcctgctggtgacggaagtaccgcctcctcccgtttgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctc

SEQ ID NO: 177522 - DNA, 711 bp, Homo sapiens
  Payload ID: 14833
  Gene Symbol: RNF40
  Gene Name: ring finger protein 40, E3 ubiquitin protein ligase
  ENST ID: ENST00000563909
  CDS Start-End: 379-711
gcatctcgccgctcttccgtgccgcgaggcgccccgggctcccgccgcctaggttccaggacagccagcgctcggtcggcggctaccaaggccgggcccgttcgcctcgctccggccaatctacgcgcggagaggcgcggcggggcgaatccgtgggggcgtctccctccgtctcaacggcgacggttgccaagggggcttgtgagggaaggaaggcggaaagcgcaggctcacgccagtgggagcgaagagaacgcgcagatacgtgagaagttgcgagtgcccacctgggcgccctctcttccaggtgacggaagtaccgcctcctcccgtttgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgc

SEQ ID NO: 177523 - DNA, 586 bp, Homo sapiens
  Payload ID: 14833
  Gene Symbol: RNF40
  Gene Name: ring finger protein 40, E3 ubiquitin protein ligase
  ENST ID: ENST00000565995
  CDS Start-End: 64-586
gaaatccaagatggcggcgctaggctgaccctcctgctggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccg

SEQ ID NO: 177524 - DNA, 569 bp, Homo sapiens
  Payload ID: 14833
  Gene Symbol: RNF40
  Gene Name: ring finger protein 40, E3 ubiquitin protein ligase
  ENST ID: ENST00000566811
  CDS Start-End: 182-569
agtggcgtccagtgacgcccagtgacgtccggtgaaatccaagatggcggcgctaggctgaccctcctgctggtgagggctctggcgccgggggggacgggatccagcaggtgacggaagtaccgcctcctcccgtttgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggagg

SEQ ID NO: 177525 - DNA, 481 bp, Homo sapiens
  Payload ID: 14833
  Gene Symbol: RNF40
  Gene Name: ring finger protein 40, E3 ubiquitin protein ligase
  ENST ID: ENST00000565931
  CDS Start-End: 50-481
aaatccaagatggcggcgctaggctgaccctcctgctgccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatca

SEQ ID NO: 177526 - DNA, 991 bp, Homo sapiens
  Payload ID: 14833
  Gene Symbol: RNF40
  Gene Name: ring finger protein 40, E3 ubiquitin protein ligase
  ENST ID: ENST00000602784
  CDS Start-End: 1-45
gcggcctttggtgcccacgacttccatcgtatctacatcagctgaacctgaaactcaggggactctggaacaccatggaccctgggggctgtgcccccatctcctccccaccccaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgc

SEQ ID NO: 177527 - DNA, 597 bp, Homo sapiens
  Payload ID: 14833
  Gene Symbol: RNF40
  Gene Name: ring finger protein 40, E3 ubiquitin protein ligase
  ENST ID: ENST00000567365
  CDS Start-End: 1-534
aagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagggttatgggaggatgaggtgcagtctccagtgtggtgggcttggcctggactcctcctgctgtcagcttggggtctgggcactgtcagagttgttcccaagctgatgcctttgcctggcccaggcgcggttgacctgcccctgctgtaacacccgcaagaaggatgca

SEQ ID NO: 177528 - DNA, 5596 bp, Homo sapiens
  Payload ID: 14834
  Gene Symbol: RNF41
  Gene Name: ring finger protein 41, E3 ubiquitin protein ligase
  Uniprot ID: Q9H4P4
  ENST ID: ENST00000345093
  CDS Start-End: 371-1324
tctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttcctttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctctaaattcttcagcattactccctttcttgagaaggtttcccctctgcttttgcctttctctcaccttaattccctttcttccttactttgttacctacccttatcttagtgctaacttctctttcaggaggatgtctgggagtagtgtgcacttcacagctgctttcccatgtaccctcctgcattcttccctcctatctcctgttctgtagcagccaaagctctctagtgatctgaactgtgtgcttcccagggtctgcctttatcctaaattccatgtcttccctgagtggtcctgagtttttgggataatttctacagaagatatgtatatatctttttcctttgtcccacaagcaactttgctttagaatctagaattcctttgcaggcagagaagtctctacctcccagtgtttcctagctaagaacgtaaatgtgaggagggaaatgtacttgcagaggtttcataattatttacttataaaaatagtcttcatagccgggcgcggtggctcacgcctgtaatcccagcactttgggaggccgaggtgggtggatcacaaggtcaggagttcgagaccatcctggctaacacagtgaaaccccgtctctactaaaaatacaaaaaattagccgggcgtggtggcaggcacctgtagtcccagctacttaggaggctgaggcaggagaatggcgtgaacccgggaggcagagcttgcagtgagcagagattgggccactgcattccagcctgggcgacagagcaaggctccgtctaaaaaaaaaaaaaaaaaaaaaagtcttcataggccgggcacggtggctcacgtctgtaatcccagcactttgggaggccaaggtgggtggatcacaacgtcaggagatcgagaccatcctggctaacatggtgaaaccctgtctctactaaaaatataaataaattagccggacaggcgcctgtcctcccagctactcaggaggctgaggcaggagaatggtgtgaacctgggaggcggagcttgcagtgagctgagatcacgccactgcactccagcctgggcaacagagcaagactccgtctcaaaaaaaaaaaaaaaaaaaccagtcttcataagtatttgctgctacctttccctgtcataagaaaaaggatagccagacatggtgggacgccactatgatcccagctccttggaaggctaaggcacaagaatcgcttgaacctgggaggtggaggttgcagtgagctgagatcatgccactgcactccagcctggtgacagagcaagagcctgtctcaaaaaaaaaaaagaaaagaaaagaaaaagggatatcttttcctcctcccagaagtttgttttaaatttgagcatttatcatgcacctgatgtaaacctaatagtactcttgatactctagtggcttgaaaaaaaaaaaaaaggcatttctgtgctgagtctgcgcttctatgcacacaaggtatgtttataaaatactgataagcatgtcacagtatagagcataagaggcaatgtatgtatcctagtgacattagcagtgcttttccccccttaaactcctttaaaattacttttagaacttgctgctcattcttgtgaatgttatgaatggtgtcatattgtccttttacagaagatacgatttttagaaacaaatattcattgaatgtctgccctgtgagatactcactagagtgaacatgaggaggcttatgtagcaaaatggcacctacctgcaaagaacttagtccctaatggagatgaatatataataagggatcataaatgtgctaagtggatttactagtaatatgtgagccaaggacgataaagctcctgattctgatgggtatcaggaaaggcttttcaggaagtgttacttgttataggtcagaggtcagcaaactacaggttacaaccccactgcctgcttttgtaaaaaactttattggaatacagttatgcccacttgtttatatattgtctgtggctgctttcacattacaacagcagggttaagtagctggaacaaagcctaaaatacttggtcttttacagaaaaaaatttgccaacctgttctaaacttttaaggtcaggagaactgggggaaggagggagtagaaagaacactgtcacccagactggagtgcagtggcaccatcatatagctcactgtagcctcaaactcctgggctctagtggtcttcccacttcagcttctggagtagctggggctactgcacctggaattgtcttaatctgttttaatactagtaaaattttttttgtttcatctctttcagtga

SEQ ID NO: 177529 - DNA, 2452 bp, Homo sapiens
  Payload ID: 14834
  Gene Symbol: RNF41
  Gene Name: ring finger protein 41, E3 ubiquitin protein ligase
  Uniprot ID: Q9H4P4
  ENST ID: ENST00000394013
  CDS Start-End: 715-1455
acgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacagaccagcttttgatacagccatgcactctgcattttgatgtgaaagctgccaccttcaataggtcatttctctgccagccttgccagaccagagtcagttgtatcatcctggggcaagtatgaggagaagctcacgattaccaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttcctttttttttttttaagaaaggaaaaaagaaaaaaaaatcaaacttgaaa

SEQ ID NO: 177530 - DNA, 890 bp, Homo sapiens
  Payload ID: 14834
  Gene Symbol: RNF41
  Gene Name: ring finger protein 41, E3 ubiquitin protein ligase
  ENST ID: ENST00000549038
  CDS Start-End: 320-890
gatgtcccaggggtattggggcggggggttgaaataactggggttcaggaggagggatggtggtagagataaaaatgtgagaagggagcagcactggcgaggagtcgggagagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctgg

SEQ ID NO: 177531 - DNA, 1193 bp, Homo sapiens
  Payload ID: 14834
  Gene Symbol: RNF41
  Gene Name: ring finger protein 41, E3 ubiquitin protein ligase
  Uniprot ID: Q9H4P4
  ENST ID: ENST00000552656
  CDS Start-End: 240-1193
gcaaaggatccgtctgaggcggcgacgagtgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataa

SEQ ID NO: 177532 - DNA, 716 bp, Homo sapiens
  Payload ID: 14834
  Gene Symbol: RNF41
  Gene Name: ring finger protein 41, E3 ubiquitin protein ligase
  ENST ID: ENST00000552244
  CDS Start-End: 108-713
ccggcaccagggcagtactgtggccgctgcggcctcagctccgactgggtcaggttgcggagactccaggccgcttccagggcggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgagtg

SEQ ID NO: 177533 - DNA, 796 bp, Homo sapiens
  Payload ID: 14834
  Gene Symbol: RNF41
  Gene Name: ring finger protein 41, E3 ubiquitin protein ligase
  ENST ID: ENST00000549119
  CDS Start-End: 202-387
ctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggtcatttctctgccagccttgccagaccagagtcagttgtatcatcctggggcaagtatgaggagaagctcacgattaccaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcaggtaggccccaagaca

SEQ ID NO: 177534 - DNA, 2552 bp, Homo sapiens
  Payload ID: 14834
  Gene Symbol: RNF41
  Gene Name: ring finger protein 41, E3 ubiquitin protein ligase
  ENST ID: ENST00000547967
  CDS Start-End: 672-1064
cccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacagaccagcttttgatacagccatgcactctgcattttgatgtgaaagctgccaccttcaataggtcatttctctgccagccttgccagaccagagtcagttgtatcatcctggggcaagtatgaggagaagctcacgattaccaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtagcttacaacccagagaagaggaggcagagtgcaagtccaggaaagtgatctctaaaatgcagcaaaaacaagcgaagtatacaagtgaagtctaagatctctttcagttctggagtcctatacagttcatagagtaaactgtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttcctttttttttttttaagaaaggaaaaaagaaaaaaaaatcaaacttgaaa

SEQ ID NO: 177535 - DNA, 582 bp, Homo sapiens
  Payload ID: 14834
  Gene Symbol: RNF41
  Gene Name: ring finger protein 41, E3 ubiquitin protein ligase
  ENST ID: ENST00000551711
  CDS Start-End: 144-582
gtctgaggcggcgacgagtggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatga

SEQ ID NO: 177536 - DNA, 5216 bp, Homo sapiens
  Payload ID: 14834
  Gene Symbol: RNF41
  Gene Name: ring finger protein 41, E3 ubiquitin protein ligase
  Uniprot ID: Q9H4P4
  ENST ID: ENST00000615206
  CDS Start-End: 320-1273
gatgtcccaggggtattggggcggggggttgaaataactggggttcaggaggagggatggtggtagagataaaaatgtgagaagggagcagcactggcgaggagtcgggagagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttcctttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctctaaattcttcagcattactccctttcttgagaaggtttcccctctgcttttgcctttctctcaccttaattccctttcttccttactttgttacctacccttatcttagtgctaacttctctttcaggaggatgtctgggagtagtgtgcacttcacagctgctttcccatgtaccctcctgcattcttccctcctatctcctgttctgtagcagccaaagctctctagtgatctgaactgtgtgcttcccagggtctgcctttatcctaaattccatgtcttccctgagtggtcctgagtttttgggataatttctacagaagatatgtatatatctttttcctttgtcccacaagcaactttgctttagaatctagaattcctttgcaggcagagaagtctctacctcccagtgtttcctagctaagaacgtaaatgtgaggagggaaatgtacttgcagaggtttcataattatttacttataaaaatagtcttcatagccgggcgcggtggctcacgcctgtaatcccagcactttgggaggccgaggtgggtggatcacaaggtcaggagttcgagaccatcctggctaacacagtgaaaccccgtctctactaaaaatacaaaaaattagccgggcgtggtggcaggcacctgtagtcccagctacttaggaggctgaggcaggagaatggcgtgaacccgggaggcagagcttgcagtgagcagagattgggccactgcattccagcctgggcgacagagcaaggctccgtctaaaaaaaaaaaaaaaaaaaaaagtcttcataggccgggcacggtggctcacgtctgtaatcccagcactttgggaggccaaggtgggtggatcacaacgtcaggagatcgagaccatcctggctaacatggtgaaaccctgtctctactaaaaatataaataaattagccggacaggcgcctgtcctcccagctactcaggaggctgaggcaggagaatggtgtgaacctgggaggcggagcttgcagtgagctgagatcacgccactgcactccagcctgggcaacagagcaagactccgtctcaaaaaaaaaaaaaaaaaaaccagtcttcataagtatttgctgctacctttccctgtcataagaaaaaggatagccagacatggtgggacgccactatgatcccagctccttggaaggctaaggcacaagaatcgcttgaacctgggaggtggaggttgcagtgagctgagatcatgccactgcactccagcctggtgacagagcaagagcctgtctcaaaaaaaaaaaagaaaagaaaagaaaaagggatatcttttcctcctcccagaagtttgttttaaatttgagcatttatcatgcacctgatgtaaacctaatagtactcttgatactctagtggcttgaaaaaaaaaaaaaaggcatttctgtgctgagtctgcgcttctatgcacacaaggtatgtttataaaatactgataagcatgtcacagtatagagcataagaggcaatgtatgtatcctagtgacattagcagtgcttttccccccttaaactcctttaaaattacttttagaacttgctgctcattcttgtgaatgttatgaatggtgtcatattgtccttttacagaagatacgatttttagaaacaaatattcattgaatgtctgccctgtgagatactcactagagtgaacatgaggaggcttatgtagcaaaatggcacctacctgcaaagaacttagtccctaatggagatgaatatataataagggatcataaatgtgctaagtggatttactagtaatatgtgagccaaggacgataaagctcctgattctgatgggtatcaggaaaggcttttcaggaagtgttacttgttataggtcagaggtcagcaaactacaggttacaaccccactgcctgcttttgtaaaaaactttattggaatacagttatgcccacttgtttata

SEQ ID NO: 177537 - DNA, 5516 bp, Homo sapiens
  Payload ID: 14835
  Gene Symbol: RNF43
  Gene Name: ring finger protein 43
  Uniprot ID: Q68DV7
  ENST ID: ENST00000407977
  CDS Start-End: 722-3073
atatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaatgtggtctggtcttgtggttttgttctgtcgtgactgtcactcagggtaacaacgtcatctctttctacatcaagagaagtaaattatttatgttatcagaggctaggctccgattcatgaaaggatagggtagagtagagggcttggcaataagaactggtttgtaagcccctaaaagtgtggcttagtgagatcagggaaggagaaagcatgactggattcttactgtgcttcagtcattattattatactgttcacttcacacattatcatacttcagtgactcagaccttgggcaaatactctgtgcctcgctttttcagtccataaaatgggcctacttaatagttgttgcaggacttacatgagataatagagtgtagaaaatatgttccaaagtggaaagttttattcagtgatagaaaacatccaaacctgtcacagagcccatctgaacacagcatgggaccgccaacaagaagaaagcccgcccggaagcagctcaatcaggaggctgggctggaatgacagcgcagcggggcctgaaactatttatatcccaaagctcctctcagataaacacaaatgactgcgttctgcctgcactcgggctattgcgaggacagagagctggtgctccattggcgtgaagtctccagggccagaaggggcctttgtcgcttcctcacaaggcacaagttccccttctgcttccccgagaaaggtttggtaggggtggtggtttagtgcctatagaacaaggcatttcgcttcctagacggtgaaatgaaagggaaaaaaaggacacctaatctcctacaaatggtctttagtaaaggaaccgtgtctaagcgctaagaactgcgcaaagtataaattatcagccggaacgagcaaacagacggagttttaaaagataaatacgcatttttttccgccgtagctcccaggccagcattcctgtgggaagcaagtggaaaccctatagcgctctcgcagttaggaaggaggggtggggctgtccctggatttcttctcggtctctgcagagacaatccagagggagacagtggattcactgcccccaatgcttctaaaacggggagacaaaacaaaaaaaaacaaacttcgggttaccatcggggaacaggaccgacgcccagggccaccagccc

SEQ ID NO: 177538 - DNA, 2610 bp, Homo sapiens
  Payload ID: 14835
  Gene Symbol: RNF43
  Gene Name: ring finger protein 43
  ENST ID: ENST00000581868
  CDS Start-End: 199-2427
aggatctgtaaaagcataattgaatttgtttcacccccgtggattccagtgggcccgacagcgcaacagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggtgagttttcagagggaagtgggtgtggtagggagaggagactacagctgaatatttcaggacaggtgaagtcagccaacaaagggttgatggaagctgagaaggatacagcagagatgacaaccaaaatacttaaccatcgggacagcgtatcatgctggctagagtgcaggaacaccccacctctgccaggtgctacccctttagttggcagatcacagggaggtcccagggaggtgctggtgtggctgaggcatcagaaaggcacttggaaggccgggtgtgatggctcatgcctgtaatcccagaactttgggaggcctaggtgggtggatcccttgaggccaggagttcaagaccaacctggccaacatggtgaaaccctatctctactaaaaatacaaaaattagccgggtatggtggcgggcacttataatcccagctactcaggaggctgaggcaggagaatcgcgtgaacctaaga

SEQ ID NO: 177539 - DNA, 3560 bp, Homo sapiens
  Payload ID: 14835
  Gene Symbol: RNF43
  Gene Name: ring finger protein 43
  Uniprot ID: Q68DV7
  ENST ID: ENST00000583753
  CDS Start-End: 65-2293
tgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 177540 - DNA, 4367 bp, Homo sapiens
  Payload ID: 14835
  Gene Symbol: RNF43
  Gene Name: ring finger protein 43
  Uniprot ID: Q68DV7
  ENST ID: ENST00000577716
  CDS Start-End: 749-3100
ggagtcagagctagaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 177541 - DNA, 5575 bp, Homo sapiens
  Payload ID: 14835
  Gene Symbol: RNF43
  Gene Name: ring finger protein 43
  Uniprot ID: Q68DV7
  ENST ID: ENST00000584437
  CDS Start-End: 1957-4308
ggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacaggtttgcagatttcttttgaaattcctttttcccccctccctctgcctcagcaaaagaaaagaatccatataacaggttcatgttcaattgcttggcttttcagcacttattctgaagactttataatatttttaaacttgaccttggaacacagagggctttgtgggtgaggtgtatttatatttacttaagggtgcacattttaaaaatcttattctgtgtttgtacaaagacgcaaattttcatagtgcctagaaatagcacagatctattctactcaagattatttgtattttttcagggtattctacctagagcctgtggttaatcgcctccctgctccccctaccttttattccctaccccctcagggaatttggatacatgtgaggaatagtcctttgtttttcttatgaacctagaaaattacagatcataaaatctggatattaaagtagtttccaaaagcatctcatgggaaatcaaagtgctcggcatttccgagctggagaataaaatcaagaatccttaagagagaaaagaaaatggagatggaaatatgaattttaactgggaaaaataattggaaagctaaccttttcaaatactctaattatgaaagttggaaaaggttgtgatgctcaggattatcctgtaatgtgtgaagatacataaattagcacctaatttataggcaaattttggtaaaacacaaaaaattatggtatgtctaagttcatgaaaagtatgtaaatgcagtgggcctagaaacctggccacactgaaatacagtttaatgtggaaacttttctaaatacatattgtagcatctttggacatcaacgtgtggcctgaaatttttattattgttccctcttctcctccattaaaaaaaaaatctccttgtggtatttagtcatttaccattaacacatattatggcttaaaaagggccatcccttccttttctgagctggagttcttcacgctcacctttgatgcatggccttagctgtttactttgccttgttttgttcatgaacattgggtttagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 177542 - DNA, 2198 bp, Homo sapiens
  Payload ID: 14835
  Gene Symbol: RNF43
  Gene Name: ring finger protein 43
  Uniprot ID: Q68DV7
  ENST ID: ENST00000577625
  CDS Start-End: 212-2182
acagcctcatctctgggacctgaatagacaatttatcatttgaagaaaattaagactataactttaagaaattatcttctggtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagc

SEQ ID NO: 177543 - DNA, 4155 bp, Homo sapiens
  Payload ID: 14836
  Gene Symbol: RNF44
  Gene Name: ring finger protein 44
  Uniprot ID: Q7L0R7
  ENST ID: ENST00000274811
  CDS Start-End: 526-1824
gcggggcggggcccctgcgggcttgcagcgggctactgtttgccggagcctcccggcgcgcccccgcgagccccctcccgtctggcgcgcgaccccgccgcttcgaatgttgtgaatcaaatgtggggtttgttacattccgctgccgccgcggacagttcttaaagggccagccgccggctgccgcgcagacccagctgcgtcctgcgccgcctcccgctccctgagggcctgggccgagagagactgatcgcgcgtgggcctcgcgaggcagacgccgtcgggcggacaacaaagagagaggccccggaaggagccgggctgcccccggacccgggggtggggaggggagcacattgttccgcagggcgggagctcttaaaggatccagacaggcaccccccccctcccccgccccctgcccagtttggccgtcctagatcgggaacaaaggagtcaacgtgtggccgggcggccaaagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagccctggcctcgagggccccctggccagcccgcctgcccgggatgagcgcttaccctcccagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcccctccagcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtataccaacgaccgcccacgctg

SEQ ID NO: 177544 - DNA, 887 bp, Homo sapiens
  Payload ID: 14836
  Gene Symbol: RNF44
  Gene Name: ring finger protein 44
  ENST ID: ENST00000504160
  CDS Start-End: 402-539
ggggtttgttacattccgctgccgccgcggacagttcttaaagggccagccgccggctgccgcgcagacccagctgcgtcctgcgccgcctcccgctccctgagggcctgggccgagagagactgatcgcgcgtgggcctcgcgaggcagacgccgtcgggcggacaacaaagagagaggccccggaaggagccgggctgcccccggacccgggggtggggaggggagcacattgttccgcagggcgggagctcttaaaggatccagacaggcaccccccccctcccccgccccctgcccagtttggccgtcctagatcgggaacaaaggagtcaacgtgtggccgggcggccaaagggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgc

SEQ ID NO: 177545 - DNA, 848 bp, Homo sapiens
  Payload ID: 14836
  Gene Symbol: RNF44
  Gene Name: ring finger protein 44
  ENST ID: ENST00000506378
  CDS Start-End: 1-679
cccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggtaacactgcccaggtctgctcctgggtattcctcatgcagtgacggggggatgggctggcctgggctgtttccctccttgtccttgtcatcatctcggaagttctggctccagcggaccaagtccccccaggtggctgcacagatgtggtgggttggggctggtgagagcaacgcctgacgtgcatgttcccacaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggccc

SEQ ID NO: 177546 - DNA, 1647 bp, Homo sapiens
  Payload ID: 14836
  Gene Symbol: RNF44
  Gene Name: ring finger protein 44
  ENST ID: ENST00000513029
  CDS Start-End: 340-480
agacgttagctcgtttgcatgggtggtccgccattggtctgttgggcaatctgggccgtaccagctttttaaagacgccgtgtagtataaacaaggagaagtggggcggccgggccatgatgtcagcgcggtgctgcagctcttgggggtgacgtcatctccgggaaggtggccggcccagggttgttagagccagcataaccacttgggccgctctcgccccgtcagaggtcagacccattgcacttcagtatctcaggcggcaccctgtccccgaggaggggaccatgacacaggttgtgagtcccggcccagcccctccacccccctgcccccccgatgcgaccatgggctctggcagtgactaggtggccaccctccgcccccgtgggccagcggcgattctctgcgggacctggcagcaccccgggccagctctggggaagcagccgccgtcccgacctccacacctccccgtagaggagcgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggcttccccttgcctacaggccagcacatccctggctgcagtgcccagcagctcccagcatgctccgtgatgttcagtgggcagcattaccccctctgctgcctcccgcccccgcttatccaggcgtgcaccatgcagcagctgcctgtgccctatcaggcctacccccacctcatctccagtgaccactacatcctgcaccccccaccaccggccccacccccccagcccacccacatggcgcccctggggcagtttgtgtctctgcagacccagcaccctcggatgcccctccagcggctcgacaacgacgtggacctgcgtggggaccagccctccctgggcagcttcacctactccacctctgcgcctggcccagccctttccccgtcggtgcccctgcactacctgccccacgatccgctgcaccaggagctgtcctttggtgtgccatattctcacatgatgccacggagactgagcacccagagataccgcctgcagcagccactgcccccgccgcccccacccccacccccaccaccctactaccccagcttcctgccctacttcctctcgatgctgccaatgtcaccaacagcaatggggcccaccatcagcctggacctggacgtggatgatgtggagatggagaactatgaggccctcctgaacctggccgagcggctgggagatgccaagccccggggtctcaccaaagcagacatagagcagctcccgtcgtaccgctttaacccggacagccatcagtcggagcagacgctgtgtgtggtctgcttcagtgacttcgaggcgcggcagctgctccgagtcctcccctgcaaccatgagttccacaccaagtgtgttgacaagtggttgaaggccaaccggacgtgtcccatctgccgggccgacgcctccgaggtgcccagggaggctgagtgaggccacgcagccgcctgcccgggagaaccctgcctgaagctctggaaacttgtgggtggggcccagggag

SEQ ID NO: 177547 - DNA, 1168 bp, Homo sapiens
  Payload ID: 14837
  Gene Symbol: RNF5
  Gene Name: ring finger protein 5, E3 ubiquitin protein ligase
  Uniprot ID: Q99942
  ENST ID: ENST00000375094
  CDS Start-End: 159-701
gaattctttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatata

SEQ ID NO: 177548 - DNA, 1168 bp, Homo sapiens; identical to SEQ ID NO: 177547
  Payload ID: 14837
  Gene Symbol: RNF5
  Gene Name: ring finger protein 5, E3 ubiquitin protein ligase
  Uniprot ID: Q99942
  ENST ID: ENST00000413786
  CDS Start-End: 159-701

SEQ ID NO: 177549 - DNA, 1162 bp, Homo sapiens
  Payload ID: 14837
  Gene Symbol: RNF5
  Gene Name: ring finger protein 5, E3 ubiquitin protein ligase
  Uniprot ID: Q99942
  ENST ID: ENST00000456167
  CDS Start-End: 153-695
tttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccagagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccggcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttcatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatata

SEQ ID NO: 177550 - DNA, 1168 bp, Homo sapiens; identical to SEQ ID NO: 177547
  Payload ID: 14837
  Gene Symbol: RNF5
  Gene Name: ring finger protein 5, E3 ubiquitin protein ligase
  Uniprot ID: Q99942
  ENST ID: ENST00000445885
  CDS Start-End: 159-701

SEQ ID NO: 177551 - DNA, 1168 bp, Homo sapiens; identical to SEQ ID NO: 177547
  Payload ID: 14837
  Gene Symbol: RNF5
  Gene Name: ring finger protein 5, E3 ubiquitin protein ligase
  Uniprot ID: Q99942
  ENST ID: ENST00000432616
  CDS Start-End: 159-701

SEQ ID NO: 177552 - DNA, 1168 bp, Homo sapiens; identical to SEQ ID NO: 177547
  Payload ID: 14837
  Gene Symbol: RNF5
  Gene Name: ring finger protein 5, E3 ubiquitin protein ligase
  Uniprot ID: Q99942
  ENST ID: ENST00000453473
  CDS Start-End: 159-701

SEQ ID NO: 177553 - DNA, 1168 bp, Homo sapiens; identical to SEQ ID NO: 177547
  Payload ID: 14837
  Gene Symbol: RNF5
  Gene Name: ring finger protein 5, E3 ubiquitin protein ligase
  Uniprot ID: Q99942
  ENST ID: ENST00000449794
  CDS Start-End: 159-701

SEQ ID NO: 177554 - DNA, 357 bp, Homo sapiens
  Payload ID: 14837
  Gene Symbol: RNF5
  Gene Name: ring finger protein 5, E3 ubiquitin protein ligase
  ENST ID: ENST00000472060
  CDS Start-End: 76-351
gtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccaggtgagagact

SEQ ID NO: 177555 - DNA, 2763 bp, Homo sapiens
  Payload ID: 14838
  Gene Symbol: RNF7
  Gene Name: ring finger protein 7
  Uniprot ID: Q9UBF6
  ENST ID: ENST00000273480
  CDS Start-End: 139-480
gggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaactcttactcttaatttgttcctaatacgtatttttggcagggagagggaacggtccatgaaatctttatgtgatataaggattttaagtttgggccagtgaacagggtaaataaaatttaacttttgagcatatggaattttgattgcctttaaagttactattctgtatcattgattcatcaagaaaacctagatctgcactcacctcactgttcaatcattgagtggtaaaggacagaagtattttctagttctggtcagatgatataattttttttttttttttttgtgggggtgaagtcttgctctgccacccaggctggagtgcagtggcatgatgtcaactcactgcaacctccgcctcccgggttcaagtgattctcctgcctcagcctcccgagtagctgggattacaggtgtgtgccaccacacccggctaatttttgtatttttagtagagacgggatttccccatgttggccaggctggtctcaaactcctgacctcaggtgattcgcccacctcagcctcccaaagtgctgggattacaggtgtgggccactgcacctggcccagatgatataatttaactgtgttttaggtaacatgttaatgagggaaaatgtttaccagtgtagcattggatcaaaaagtttatcacacagtgttttaataaatggtttattctgcttaccttatttgaattgtcattataattttatatgcaaccttaatttgtcaagtaaatactttcatttaatttgaaagaattcatattcatttgctctttcatttgacaataataaaatttaaggtttattacctggaaagagtgcaagaaaatactaaacaactttatcaaactgattcacactgaggggaggttattttgtaacaaataatggaccacaagttcattttgtattcttctgtagtagaggctactgatatgaatttaagaaaaaaccttagaatcttaacttttcacatctgcagatgcagtgtgccattctgaatttttcaatctaagggatgtggatacatagaatgtttaaaaagataacaattagaatgaaaaattaaaattatgtatgcttttatatgggttactttttattgatcacatttctctggaaatttttctttatattttttcacagttgtctttctagctactgaaaaaattatacaaatatctttggccatttaaatgtttatcattgtgcagtgaactgttttagtaactttctgtttgacctttttagaaggttgcatccttaaaatgtgaaccagatacatggctttgcattgaagaggaaagcagtagaatgtcaggttactttaggcagtgtgacagtatataaatgaaatgtggaggatggtggtaacaatttgattttccacacagcaaaaccacagtcccgccacctaacaaagccctgtttatgccacacaccagcatctgagggaagaggaggcactgtgacaaagcagcgctgatgctgctcagcctgcgatgattacagctcatctgcacagccatctgaaagtttaatacatactcatcagagggaacatgccgggacaattttgggttccaatacaaaagttaagcatcaaacaggtttttctttccatttgattaaatgtgctgattttattttactgttgcattagaaacaaacaagttatctttcgctatttaattttccctctatgcaaattgtgttattacagctgaccgctatcagtaaatcttaattctgtcagtcccattgcttccttttttataaaaatactgtgtccccctttactgtcatgaagtgaaattcataaatatatttcctacacatataa

SEQ ID NO: 177556 - DNA, 805 bp, Homo sapiens
  Payload ID: 14838
  Gene Symbol: RNF7
  Gene Name: ring finger protein 7
  Uniprot ID: Q9UBF6
  ENST ID: ENST00000393000
  CDS Start-End: 46-318
ccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccagatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaa

SEQ ID NO: 177557 - DNA, 782 bp, Homo sapiens
  Payload ID: 14838
  Gene Symbol: RNF7
  Gene Name: ring finger protein 7
  Uniprot ID: Q9UBF6
  ENST ID: ENST00000480908
  CDS Start-End: 66-359
agagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaaccc

SEQ ID NO: 177558 - DNA, 1036 bp, Homo sapiens
  Payload ID: 14838
  Gene Symbol: RNF7
  Gene Name: ring finger protein 7
  Uniprot ID: Q9UBF6
  ENST ID: ENST00000477012
  CDS Start-End: 39-365
caagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgagggaattggagttcgtaattggtccgaggccctgaacctaataaatgccagtgaaatgggatttgactgtagatctggctccacagccctcgctgtcccctctgtctcactggcttctcaccagccttgtctggatgaccatcggtagcaacctattggaagcatacaaagcagtttattttagaggaactctcaagtgtcttagggtagaaagtaaaaagttgcttcttatgagttgctaaaggaaggcttctgtgtcaatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgtt

SEQ ID NO: 177559 - DNA, 862 bp, Homo sapiens
  Payload ID: 14838
  Gene Symbol: RNF7
  Gene Name: ring finger protein 7
  ENST ID: ENST00000477393
  CDS Start-End: 24-230
gccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccagatgagggaattggagttcgtaattggtccgaggccctgaacctaataaatgccagtgaaatgggatttgactgtagatctggctccacagccctcgctgtcccctctgtctcactggcttctcaccagccttgtctggatgaccatcggtagcaacctattggaagcatacaaagcagtttattttagaggaactctcaagtgtcttagggtagaaagtaaaaagttgcttcttatgagttgctaaaggaaggcttctgtgtcaatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtg

SEQ ID NO: 177560 - DNA, 2124 bp, Homo sapiens
  Payload ID: 14839
  Gene Symbol: RNF8
  Gene Name: ring finger protein 8, E3 ubiquitin protein ligase
  Uniprot ID: O76064
  ENST ID: ENST00000229866
  CDS Start-End: 151-447
gagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagttttccttctgaaaaggcagaagattttacagcagcaggagagagattcctttaagaagacgaaaatcatgaagcttatttcttctttctttcactttccccagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacgtactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagag

SEQ ID NO: 177561 - DNA, 5631 bp, Homo sapiens
  Payload ID: 14839
  Gene Symbol: RNF8
  Gene Name: ring finger protein 8, E3 ubiquitin protein ligase
  Uniprot ID: O76064
  ENST ID: ENST00000373479
  CDS Start-End: 194-1651
cttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacgtactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagtta

SEQ ID NO: 177562 - DNA, 835 bp, Homo sapiens
  Payload ID: 14839
  Gene Symbol: RNF8
  Gene Name: ring finger protein 8, E3 ubiquitin protein ligase
  ENST ID: ENST00000498460
  CDS Start-End: 1-625
gccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggaggaagagaaggagaagatgcaagcacagaaggaagaagttcttagccacatgaatgatgtgctagagaatgagctccaatgtattatttgttcagaatacttcattgagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttg

SEQ ID NO: 177563 - DNA, 731 bp, Homo sapiens
  Payload ID: 14839
  Gene Symbol: RNF8
  Gene Name: ring finger protein 8, E3 ubiquitin protein ligase
  ENST ID: ENST00000487950
  CDS Start-End: 116-731
gtctgttatttagatatggaagctgaggggatgcacagaggcagccagaacctaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacaga

SEQ ID NO: 177564 - DNA, 1800 bp, Homo sapiens
  Payload ID: 14839
  Gene Symbol: RNF8
  Gene Name: ring finger protein 8, E3 ubiquitin protein ligase
  Uniprot ID: O76064
  ENST ID: ENST00000469731
  CDS Start-End: 75-1421
gggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctg

SEQ ID NO: 177565 - DNA, 608 bp, Homo sapiens
  Payload ID: 14839
  Gene Symbol: RNF8
  Gene Name: ring finger protein 8, E3 ubiquitin protein ligase
  ENST ID: ENST00000469316
  CDS Start-End: 93-362
ttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaaggggaccaccagtttgtctaaggagaggtgaactgacccaggttggaaggagggcaggtcaaaactgctgtgctcatcaacaaagggattgcacctgtgaatagccactgcactccagtgtggctgacatagtgaagccctgtcgctatcaaaaagaaaagaagatacctaaagtgcagatatacaagcaccgaggaatgtgatgaaaatacagactatgagagtctaaatggtgtttggctgaacagagcgcgtctggaacctttaagggtctatt

SEQ ID NO: 177566 - DNA, 977 bp, Homo sapiens
  Payload ID: 14839
  Gene Symbol: RNF8
  Gene Name: ring finger protein 8, E3 ubiquitin protein ligase
  ENST ID: ENST00000494320
  CDS Start-End: 187-336
aggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttg

SEQ ID NO: 177567 - DNA, 3478 bp, Homo sapiens
  Payload ID: 14840
  Gene Symbol: RLIM
  Gene Name: ring finger protein, LIM domain interacting
  Uniprot ID: Q9NVW2
  ENST ID: ENST00000349225
  CDS Start-End: 282-2156
tttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctaagcagagtgaagaaaactaaaatccagtttattgtatttcaatactatgtcataacagtcaggtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgcttagaactgagaaaactgctttttgtgagccaacatagtaacaaacacaccaaacaaagtacaaagctgcttttgtaagtgtgtagatgtcaagagcagaacatatctataatatttaatgtgtgaacagctactgtgacatgcaaaggaaaggacagtgcagaattaaaccgtgttgaagaccagtggaaattgtataatttaacttggatttaggcaggaagtgaaatatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtttaagaaaaacaaaccactactacctagcacaagttaaatttacaagtctgctcctcaaaaatgaaaaaatggaggaaagagactataaaaccacttttagcatatgaattgcagttggtacacatgtgtgtgttaataggaaagtctcgaatttgt

SEQ ID NO: 177568 - DNA, 8317 bp, Homo sapiens
  Payload ID: 14840
  Gene Symbol: RLIM
  Gene Name: ring finger protein, LIM domain interacting
  Uniprot ID: Q9NVW2
  ENST ID: ENST00000332687
  CDS Start-End: 220-2094
tttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgcttagaactgagaaaactgctttttgtgagccaacatagtaacaaacacaccaaacaaagtacaaagctgcttttgtaagtgtgtagatgtcaagagcagaacatatctataatatttaatgtgtgaacagctactgtgacatgcaaaggaaaggacagtgcagaattaaaccgtgttgaagaccagtggaaattgtataatttaacttggatttaggcaggaagtgaaatatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtttaagaaaaacaaaccactactacctagcacaagttaaatttacaagtctgctcctcaaaaatgaaaaaatggaggaaagagactataaaaccacttttagcatatgaattgcagttggtacacatgtgtgtgttaataggaaagtctcgaatttgtgttgtttttgagatttgtcatttaaggtaccagtgcacacttgatcatatttcattactatctctaacacagtcctaacatctcaaatttaaagaccagttgaagattaagggatttttatcctttgttgaaagtcatgttgggttatttgaaattcaaattttaattgtgctgcccatatatgaaaatgagactgctgactcgctatctatggacatgcactttatgttggtttcttagtagtaagagtaacttcatgataaccccagtcttcttgcctaatttcttttttgagactagctggggttaggattagaatgactatggagcagatatttgttcttctgggaaaagctttaacaggccaaaatagggattgaacttgtccttggcctttatcaaagcaagctagctacccagacgtagtcaaatactctacaaaataaacaagtctgctttaggaattgtctgggtaccttcactgttaccaacttagctgtaaagattatttcaaagctcactcttccatgatttcttctggctttcaatcctatctaagtatcaaggaaattaacttgtaaatatggtagttgtttactaaggatatgtactgctcttgcaaggaaataatgtccaaacaaagcttcacttattttttttaatataagcagatttcactgtttatggcgcttatgtaatacattttatctttttaaaaatttgtccgtgtaaaagtcaggattcctttatatttgtgagcctccttttctcctttcctaaggatgtaatctacagttttcagatctgcagggtagtcttgattggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaagctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgttttgttttgttttgttttgtttttttgagacagagtcttacttggttgcccaggatgaagtgcaatggagcgatctcggctcactgcaacctctgcctcctgggttcaagcaattctcctgtctcagcctctcgagtagctgggattacaggcgcatgccaccacacctggctagtttttatatttttagtagagatggggacttcaccgtgttggccaggctggtcttgaactcctgacctcaagtgatgtgcctgcctcggcctccgaaaatgctgggattacaggcgtgagccaccatgtccagccaaagttgaggtttattagtactattagaaacaaaattgagcaagttaagttaaaagtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaaaaaattataatctgccttatttgattttttttttaagttttaccttacaggcttccctgtcacatgttttaccatattaagtacatagaagccatgtttgcagggcacttttattctcctagtcttataagactatgctaattgttactttctgaagtattctgtaccttagtatgcaagattgttaaggcacatgttaaagtgtcaggtgtgtttttttccctttaattcttcagtatgtttatattcaataacagtattgtaattcattgagttaactagtaaattgtgtgcttttgaaaaaacatgaaaaatgtaaattgacagcatacttcatttggaaaaaagtaaaagatccgaggaactagtatgtcacttatttatttttattttattttattttttactttttgagacagggtcttgctctgtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagtgctgggattataggcgtgagccactgcgcccagccttacttatttttaaatcagattttttaatcaactaaaacagctatgagttaagtacctgccctgcaaaaatttttagaaaaagttttaggattatgaaattaagaattattttccttaactggaacagttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggctgagtagtagatatcttaaagacatgcagtgaaagtgaaccctgtcatatcatggtgcctctttcaaggttcctctgtaagttcctcatcttgcagaattatttcaataccaaggtatggttgaaccagctgtccagccttaactctatttagtgccccattactaatgttcttttaactggtttgtatgtgttttaactgtccagtgtttggattttacctcttgatagctccatttgtccctggtgctgcttttaaggatgtagggccatgtgatcaggtatcaagttgagtaggtacgcagttggcctggtgatgtatctgtgcctgttttatcttctcccaggaagagctgctttggtatagttgtttacttggattcatacaaagaacagggcagcaatcttggaaagctttctgaagcttataagaacctgaaggggtttggagggggaacagtaacaaaggctgcctttatgtctttggtcacaaagcacatagatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtgcttgatcatctctccttgggtttttctttaaaaaggggaatctgctataaaggttctgttgcttcaaaccaatgtcaaatagacttgatttttagagtcatggaattacagtgcaaccttgatttttattcccctcactgctatgagtgtgggcaggtactggtttatatgttataacttccgttttatctgtgttgtgtagttgaatggcttaatcgttgagtggtaaaataaaagattatattccaatacaagaatcctggaaa

SEQ ID NO: 177569 - DNA, 2101 bp, Homo sapiens
  Payload ID: 14841
  Gene Symbol: RNFT1
  Gene Name: ring finger protein, transmembrane 1
  Uniprot ID: Q5M7Z0
  ENST ID: ENST00000305783
  CDS Start-End: 57-1364
gaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatttgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattcattttgtctctggacgtcataaattcttcctgccatcagctttaatgttcatgatcatgctttttgtatagtaccatggagtatctcgaagtaactattaaaataattcatgtggattataaa

SEQ ID NO: 177570 - DNA, 868 bp, Homo sapiens
  Payload ID: 14841
  Gene Symbol: RNFT1
  Gene Name: ring finger protein, transmembrane 1
  ENST ID: ENST00000442346
  CDS Start-End: 75-671
gttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaaggctgcaaaaaagtcttccatatattttgattctgagcgtcaaacttgtatgcagcatataacaggaatttctcttggaattgggctgctaacaacttttatgtatgcaaacaaaagcattgtaaatcaggtttttctaagagtaagttaacaagcaactaaaaaattattaactgtttctctccatagattttagagaaataattttgagagaaataggaaataacttgaaagaaataggaagtaataggatatattgtaacatccacgttatgttaaatttgttatctaaatcctggaataaattatctctcctaatgctgaattccttcaccttaccttctttgt

SEQ ID NO: 177571 - DNA, 1893 bp, Homo sapiens
  Payload ID: 14841
  Gene Symbol: RNFT1
  Gene Name: ring finger protein, transmembrane 1
  Uniprot ID: Q5M7Z0
  ENST ID: ENST00000482446
  CDS Start-End: 72-809
gccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagacttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatttgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattca

SEQ ID NO: 177572 - DNA, 1809 bp, Homo sapiens
  Payload ID: 14841
  Gene Symbol: RNFT1
  Gene Name: ring finger protein, transmembrane 1
  ENST ID: ENST00000466544
  CDS Start-End: 99-617
ccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatttgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaaga

SEQ ID NO: 177573 - DNA, 618 bp, Homo sapiens
  Payload ID: 14841
  Gene Symbol: RNFT1
  Gene Name: ring finger protein, transmembrane 1
  ENST ID: ENST00000484257
  CDS Start-End: 1-215
gggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacaggctagaaaggtgtcaactatgacaaaccgtgaagactttttccttattctatgaagggaagatctaaaatccaaacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaacca

SEQ ID NO: 177574 - DNA, 740 bp, Homo sapiens
  Payload ID: 14841
  Gene Symbol: RNFT1
  Gene Name: ring finger protein, transmembrane 1
  ENST ID: ENST00000589113
  CDS Start-End: 72-740
gccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacagcttaatttttttaaatcctactttggaccatttgagcttctgggaagtattttggattgttggaattacagacttcattctg

SEQ ID NO: 177575 - DNA, 3882 bp, Homo sapiens
  Payload ID: 14842
  Gene Symbol: RNFT2
  Gene Name: ring finger protein, transmembrane 2
  Uniprot ID: Q96EX2
  ENST ID: ENST00000257575
  CDS Start-End: 234-1568
acatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggctgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagcacgtgttctgtgaggagtgcctctgcctgtggctggaccgtgagcgcacctgcccgctctgccgctcggtcgccgtggacaccctgcgctgctggaaggacggcgccacgtccgcacacttccaggtgtactaggaccgaacactgaggacacccagaaggacgccaagggtcagcatgcccggacccagccctgcgggggcttcctgagaaacaggcctcaagcacttacatcctgcctcttgccctccaccacctctgaccccaaagtcccgcccctgtcttgtccttctgaccttcatcttcctctctcgttctgtggtatagtgcgtgcctccttcccctgcaaaaggggacgtcttcctaactcagacttgatgcccttctagatgcatcttccttctccactccaagtcaaggacctggcaatacatgaagttcccacttgttggttattttctctttcttttttcttttcttttctttctctctctctctgtttccctccctccctccttccttccttccttccttttttttttttttttaaaacaaggtctcgctctatcacccaggctggagtgcagtggcacaatctcggctcgctgcaacctccacctcctgggttcaagcgattctcctgcctcagcctcccgagtagctgggattacaggcacccaccaacacacttggctaatttttgtattttttagtagagacagggttttgccatgttggccaggctggtctccaactcttgacctcaaatgatcagctcgcctcagcctcacgaagtgctgggattacaggcatgagccaccgtgcccaggctcacttttttttttttttttttttttttgagacagggtctgggtcttcacccaggctggagtgcagttggcacaatcacagctcactgcaaccttgaactcctgggcccaagccatcctcccgcctcagcctcccaagtagctgggactacaggtgtgtgccaccaggcctggctaatttttttttttttttaatttttagtagaggcgaggacttattatgttgtccagggtgttctcaaactcctgggctcaagcaatcctcctgtcctggcctcgcaaagtgctgagtgctggaattacaggtatgagcccctgtgcccagcccacctgctggttattttaacttagtacctagtacctaggacttgatggtgcaggctggggaggagcctagagatcactgcctcccagatagcccaggcctgcagattagaatccctgtgagccctgtgaagtattttttcttttcttttctttttttttttttttttgttgttgtgagacagagtcttgctctgttgcccaggctggagtgcaatagcacgatcttggctcactgcaacctccgcctcccgggttcaagtgattctcctgcctcagcctcccgagtagttgggacaacagatgcgtgccaccatgcccagctaattttttttttgtatttttagtagagatggggtttcaccacgttggccaggctggcctcaaactcctgacctcaagtgatccacctgcctcagcctcccagagtgctgggattacaggcatgagccaccacacctggcccaaagtattttcaaaatacagttgttgggccccaccatatacctgtaatgacttaaggtcccaaatacttcatgcgcagcaggcaaagcatgcagcatcctgcttggattacgtgctgtcatcctcacaacagccctgtgatgggggaggtactgttgggtcccctgttttatagatgaggaaacttgggcacagagcttggtgcggtaactttcccagggtcacccagccagcatgggcgggccaagtttccaacagaggcctggtacagtttcagaacccacatctaaaaaaaaataaatttattagagatgaggtttctaataaaaatccaggttgtccaggctagattcaaactcctgggctcaagtgatcctccctcctcagcctcccaagcagctgcaactacaggcacactccgctatccccagcagagcccgcactcttaacctccgcactgctctgcccctcagacattccaggcatggggcccagcagacacggtcttctaaaagcacacgagaggccgggtgtggtggcccatgcctgtagtgccagcattttgggaggctgaagcaggcgggtcacctgaggtcaagagttcaagactagcctggccaacatggcaaaaccccctctttactaaaaaatacaaaaattagccgggcgcggtggcgggtgcctgtaatcccagctactcaggaggctaaggcagggagaactgcttgaactcgggaggtgaaagttgcagtgagccgagattgcaccacagcactccaacctgggtgacagagtgagtgagactctgtctaaaaaaaaaaagaaagaaa

SEQ ID NO: 177576 - DNA, 2180 bp, Homo sapiens
  Payload ID: 14842
  Gene Symbol: RNFT2
  Gene Name: ring finger protein, transmembrane 2
  ENST ID: ENST00000319176
  CDS Start-End: 214-1179
gggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagattgcaccacagcactccaacctgggtgacagagtgagtgagactctgtctaaaaaaaaaaagaaagaaagaagggagggagggaggaaggaaggaaggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatcttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctcgctgtcagccagtattaacatgtccccttccccctgccccgccgtagattcaggacatttgcccctgtgtgccaccaaaccaggactttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccctgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaa

SEQ ID NO: 177577 - DNA, 2896 bp, Homo sapiens
  Payload ID: 14842
  Gene Symbol: RNFT2
  Gene Name: ring finger protein, transmembrane 2
  Uniprot ID: Q96EX2
  ENST ID: ENST00000392549
  CDS Start-End: 234-1568
acatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggctgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagcacgtgttctgtgaggagtgcctctgcctgtggctggaccgtgagcgcacctgcccgctctgccgctcggtcgccgtggacaccctgcgctgctggaaggacggcgccacgtccgcacacttccaggtgtactaggaccgaacactgaggacacccagaaggacgccaaggattcaggacatttgcccctgtgtgccaccaaaccaggactttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccctgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatgtaaaatatcttgagaataataaatgtgagggaataagaaaggcaagctttggacacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgc

SEQ ID NO: 177578 - DNA, 2415 bp, Homo sapiens
  Payload ID: 14842
  Gene Symbol: RNFT2
  Gene Name: ring finger protein, transmembrane 2
  Uniprot ID: Q96EX2
  ENST ID: ENST00000407967
  CDS Start-End: 234-1496
acatgctgcccaggctgcgcgggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggctgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccctgtagccatctccagggtgacggaacccagtgtattacctgctggaaccaaggaaactaacaatgtaggttactagtgaataccccaatggtttctccaattatgcccatgccaccaaaacaataaaacaaaattctctaacactgcaaagagtgagccatgcctgttaacactgtaaagaatgtaacatgtgggggacacacaggggcagatgggatggtttagtttaggattttattagtgcatgccctaccctctgggggaacgtcccatctgaggttttcttctcggtggggggatttaacttctgtcctagggaaaacagtgtctgatgaggagtgtttccaacacaggctacatgaattcccctataccagtgcgaaagcagccaggagtccccgttggaaaagaacaatgccactctcttttatgtatcttggttctgcaactcatttgttgtaagtagggttaatcgagtatcaggttcacagtatcctgcccttattattttatgattcactgactcaagttccacgaagtccttagaaatggacctcttcatgtaaaatatcttgagaataataaatgtgagggaataagaaaggcaagctttggacacagatatgataggtgcatcagcttcggaagagaagaatgatgtgcagagtgttaggaagacatccgggctgctgagactcgggattagaagaaagagaggtaaataaagtgggtcctggaatcttttaggacttctgctgtaggacaaacagctgcctttggtgttttaatgtctcccaaagtacccttcagccaataaataccatctgttggtgcaa

SEQ ID NO: 177579 - DNA, 1761 bp, Homo sapiens
  Payload ID: 14842
  Gene Symbol: RNFT2
  Gene Name: ring finger protein, transmembrane 2
  ENST ID: ENST00000547718
  CDS Start-End: 187-312
gatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagctgtgaccaaggctggcccctctggggaactgggggccattgaacttgaagactgcagagccagcggtccttgggatcccgagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagcagctgtacaacagcctcatattcctgaagcccaacctggagatgctggacttctttgacctgctatggattgtggggatcgcagactttgttctgaagtacatcaccatcgccctcaagtgcctcatcgtggccctgcccaagatcatcctggctgtcaagtccaagggaaagttctatctggtcatcgaggagctgagccagctgttccgatcccttgtccccatccagctgtggtacaaatacatcatgggtgacgactcctccaacagctacttcctgggcggggtcctgatcgttctctacagcctctgcaagtccttcgacatctgtggacgtgtgggcggagttaggaaagccctgaagcttctctgtacctctcagaactatggagtccgagccaccgggcagcagtgcacagaagctggtgacatctgcgccatctgtcaggccgagttccgagagcctctgattctcctgtgccagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccctgtagccatctccagggtgacggaacccagtgtattacctgctggaaccaaggaaactaacaatgtaggttactagtgaataccccaatggtttctccaattatgcccatgccaccaaaacaataaaacaaaattctctaacactg

SEQ ID NO: 177580 - DNA, 2176 bp, Homo sapiens
  Payload ID: 14842
  Gene Symbol: RNFT2
  Gene Name: ring finger protein, transmembrane 2
  ENST ID: ENST00000622220
  CDS Start-End: 484-1179
gggtgattggcttggctggacctgaatgatgcggctgtgattgctgaattgtctgggcaggtttggagtctctggcaagctcccctgactgtgcatccctctggagacgaagaggagggggaggcctgtcctctctgggatccattggtcacatccccctgaggattcccgaatgcctacctccagtgtcgtcaacatggagttctgaagtccatgtggctcttcacagtgaatcaggtgttaaggaagatgcagagacgccacagcagcaacacggataacattccacctgaaagaaaccgcagccaggcgctcagctccgaggcgagtgtggatgaaggtggcgtctttgagagtctgaaggcagaggcagcctccccaccagcgctcttctcgggcttatcaggcagcctccccaccagctcgttcccctccagcctggtgctgggctcctcggctggcggcggggacgtgttcatccagatgcccgcgtccagggaggaaggagggggccggggcgaggggggcgcctaccaccaccgccagccccaccaccatttccaccatggcggccaccgcgggggctccctgctgcagcacgtgggtggggaccaccgggggcactcggaggagggaggcgacgagcagcctgggacgcccgcccccgccctgtccgagctgaaggctgtgatctgctggctccagaaaggactccccttcatcctgatcctcctggccaaactgtgctttcagcataagctcggcattgctgtgtgcatcgggatggccagcaccttcgcctatgccaactccacgcttcgagaacaggtctcactgaaggagaagaggtcagtgctggtcatcttgtggatcctggcctttctggcggggaacaccctctatgtgctttatacattcagctcccagattgcaccacagcactccaacctgggtgacagagtgagtgagactctgtctaaaaaaaaaaagaaagaaagaagggagggagggaggaaggaaggaaggaaggaaagaaagaaaggtcagctttggcccagatgtggttaccccttggtctcctgtctttatgtctttctcctcttcctattctgtcatctccctcacttaagtctcaggcctgtcagcagctcctgtggacattgccatcccctctggtagccttcagagcaaacaggacaacctatgttatggatgtttccaccaaccagggtagtggcatggagcaccgtaaccatctgtgcttctgtgatctctatgacagagccacttctccacctctgaaatgttccctgctctgaaatctggcatgagatggcacaggtgaccacgcagaagccaccagaatcttgcctgccctattcctcctcccaagtctgttctcttattgtcaacctcagcacaacaggctggcgccaatggcattacagagaaagcaatctgtgtggctagtgggcagattaccatgcaagccccaggagaaatggaggagctttgtagccacctcgctgtcagccagtattaacatgtccccttccccctgccccgccgtagattcaggacatttgcccctgtgtgccaccaaaccaggactttccccttggcttggcatccctggctctctcctggtacccagcaagacgtctgttccagggcagtgtagcatctttcaagctccgttactatggcgatggccatgatgttacaatcccacttgcctgaataatcaagtgggaaggggaagcagagggaaatggggccatgtgaatgcagctgctctgttctccctaccctgaggaaaaaccaaagggaagcaacaggaacttctgcaactggtttttatcggaaagatcatcctgcctgcagatgctgttgaaggggcacaagaaattggagctggagaagattgatgaaagtgcaggtgtgtaaggaaatagaacagtctgctgggagtcagacctggaattctgattccaaactctttattactttgggaagtcactcagcctccctgtagccatctccagggtgacggaacccagtgtattacctgctggaaccaaggaaactaacaatgtaggttactagtgaataccccaatggtttctccaattatgcccatgccaccaaaacaataaaacaaaattctctaacactg

SEQ ID NO: 177581 - DNA, 7512 bp, Homo sapiens
  Payload ID: 14843
  Gene Symbol: RYBP
  Gene Name: RING1 and YY1 binding protein
  Uniprot ID: Q8N488
  ENST ID: ENST00000477973
  CDS Start-End: 1-952
gcttcctgcgcccgccgcggcccttcccggggcgccgccgccaccgcctggtgtgcgaggctatccggcccgggcccggggcttgcagggtgccagtgggggcgcccggttcccttcctcgctctctcttccagtccccggaaagggtgggtgggtggtctcccgagcgaagtttccagcactggattcctgcgaaattacgacggctcacccgcgtctgtgttttgctgtctctcccccgttttcctgctccctgcctcttccctcccttttcccccactctccactcctcggaaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttatatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacctctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaaaaaaaataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttacattggaaatctttatttttgtgtgtatagattttagcctttagaataatagttaatttttaatctgtggaatatttccaatgtgaataggaagctcactttgtattttagaacttgtttatcagaagctgaaatagctgggtatcttaagtacatacctcaaagatgcaaaaggagacataatggggcaaaagaatcaccaaaatttgaaagaaaatgaactgtctcctaagtgtaacctttgagatagattgcaatgatgtaaaggaaggaaatgggatttaaggaaagaaaatggagatgatgctaaaatatgctaattgaggactgaaaatcctcaaaagacaacccctgtttctggccaactggatttaggtcaactatgtctcagagatgtgaataaagtgtgttactaacctaaaagccacacaagctcacttattgccccatgcgagggagactcctgcctgctgctgcaggtgctgaggcataccagtctataaccttccaaagaattaagaaaccacttaaaacatgtcaagatccatccccgattattttgtcctgggtctgcacctgaactagcactggaaggaagagagtgtaaatagcgcaggatgttgagttgaaaatgggtctgttctgataaaacagcaagttccattcttcgtcctcattttttagtactgaacgtgacccaagtttggcccctcagaagtcttggaaaggatctggaagggttgaaggacagggattggatggggtctctcatgtttcccacaggccattttggatacagacgtgcgatctgctaaccccatgcccctctgcttgcttttgtgcctgaggagttcactgtgagggcccccactgctggtggcactggtaccatcctttggaggaggatgggaattgtctcccataccaggtgtggaccaaagcaagcacttggtctttacaggggaggcacaaggaagagtcgtttctttccagttgtgtggacggaaagggaggcaaaaaggttttctctaatcctcagccaaactctagtgttaacaccaagtgtccagatccccattgagaaatcccatggctagagtgtgacaggatcatggaagcagctcttgctcaattattcttgatcaagggtggaatgacgacttcagccagcaagggcccaggcttgtgctctctgatttcatagccctacggcgtggaaatggaaaccagccagactccaccttgggcagtgaagagaacataagggacgtccaggaggcccttggtctagcacgcccctgacctcccagcggttctggaaggccactcctaacccttcaaaccatagcaaggaaggttagagctatctttgtgttaggatcaaaactcgagaaggttctgtttgctaaccactgaaggaagcccacggcctgtctttagggcttctgtcaggagaggacaatggacatagacaactagatactgcaggagggctctggttttctcagacaggatcctaggatgtgtctggaagcctgcggagtgaaggtagacatgcaggtgtgatgttctgcctgatagtgcctctctccaggcattaactacaaggctgggtgggggcttactgtaaggcatcgagtccctaagcatttatacagtcccaattgtgcatcagtgcagtgctggttataacagggaagaatttgtggaggggagggcacaggctgaaattggcccattcctacacatgctcttgacctagacctagagtaagtgacattgaccccaaccgtccccctacccacctccagcttgtgccagacatcactaatcagtcacagcgcttctttccagctgaatccagactcagaatcctcattagagctcattgttagcacgtcttcctgaagtgcaacccatttgccattccttccctggacgaaacccaccccaaataactgggaaacccttcaaggcagtttttaatcaacacttcaattgtggaactgcatgaatccaagaaggccagctgagaagctcggaggagtcaggaaggaagaaaactaaatatccaacacccaactcttcaaagagttcaacttcctgttcaaaacagggtcagaccaggggattcttagtgaggccagtgatgagcactgtaactttaaatgcagccctgaaccccagacctgaaggcctgccagtgtcttaccctacaggccagaccgggacctacttgcccaagctgtcctactggttctgtcaaccgggggctctcaaataacagagtagaacaccacatggatatgattcctggaaaccacagaactaggtgagactcctacctctgactgcctgggtgtccttgggcaagtcagctgaccgggccatttccctcagttgtcaagtagggattagaggtgtatgtgctcctactgtgttctctgctccaaggaatcatggcgcagtgctcccagaggtgggttgtgtgttaccatgtttttaacaacgggaagcaaaaactttatttgaactttcattctgatgcttcactgatgacaccggaaatgaagataatttgttttgtgattgttttattgtgttttcaagttttaattcatgaattttcctgtactaaaacaaagagcaaagttggttaaagcctgcatgtaaataaagtccagtgggatttttgacacctgcttgacgtttctatgtctacaaacagtgttgtaatgaatacggcctttcatcattaaacattcgattttttaaaaatga

SEQ ID NO: 177582 - DNA, 4661 bp, Homo sapiens
  Payload ID: 14843
  Gene Symbol: RYBP
  Gene Name: RING1 and YY1 binding protein
  ENST ID: ENST00000628983
  CDS Start-End: 199-879
gcggggactagtctcgtccggagactggcagcggcggcggcggcggcggccggagctcgagccccagcggctgagggcgggcgggcgggcgcgggggagggaggggggccggtccgcgacgactccccggacggcgtttctcctccgagcggcgccggtttcggcttggggggggcggggtacagcccatccatgaccatgggcgacaagaagagcccgaccaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttacatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacgtctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaataataataataataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaattt

SEQ ID NO: 177583 - DNA, 1188 bp, Homo sapiens
  Payload ID: 14844
  Gene Symbol: RBX1
  Gene Name: ring-box 1, E3 ubiquitin protein ligase
  Uniprot ID: P62877
  ENST ID: ENST00000216225
  CDS Start-End: 41-367
gcaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacggatgctctctcttgtgtatgtgaacaaagtgaacataaatgaagagtctccccttccaaggctgaaaactcagcttttgaaagtgaaatgtttgttcatcggggccagagcagggttgtcctctgagcgcatcacttagtgacgaggaatccaacagctcaaggcagagtgtggatcaccggctcccgaaaacagcagtcagcccttctttctcctgtgtgacagcagtgggcagctgaaagagggaagaatgtgggattcagtcatcaaacccagttctgagtcctggttccacagcttgggtactgatggcaatcttggccaagttgtctctctactctgaactttcctcctctgtactgtgggcttctgaggactaagtggcatcatgtgggcacagagagaagctttgtaaaatgtaaaaccgctatacaaatgtgacctttggttgtgtatgacagcagtccccaacctttttgccaccagggattggtttcatggaagacgatttttccatggaccgggggtggggcgggggtgtgcttggggatggttttggaactgttccacctgagatcatgaggcagtagatggaccgcgcaacctagatccctcacatgcacggttcgccaatagggttgaa

SEQ ID NO: 177584 - DNA, 2810 bp, Homo sapiens
  Payload ID: 14845
  Gene Symbol: RIOK1
  Gene Name: RIO kinase 1
  Uniprot ID: Q9BRS2
  ENST ID: ENST00000379834
  CDS Start-End: 508-2214
agcgaccctactgtgggtgcggtgtcttcccagagagtggtgaagttaggaaggtacgaccccctaggccgaacagcctgtgggctagctggcgcctcctgccgcagtaaacacaaagtggggtacagaaacgaaaactccgggaagaaacggccagcacgggcctcgccgtgccggctactcaacacgccttcctgagagcacagaacatccacagccctatacagcgcgccatccagagagctccggactcccagctcggcgcaggggcgggacttccgctcaagtcagacttccgggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgacgatgatgatgatgactgggactgggatgaaggagttggaaaactcgccaagggttatgtctggaatggaggaagcaacccacaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaaccctaggaaaatggtgaaaacttgggcagaaaaagaaatgaggaacttaatcaggctaaacacagcagagataccatgtccagaaccaataatgctaagaagtcatgttcttgtcatgagtttcatcggtaaagatgacatgcctgcaccactcttgaaaaatgtccagttatcagaatccaaggctcgggagttgtacctgcaggtcattcagtacatgagaagaatgtatcaggatgccagacttgtccatgcagatctcagtgaatttaacatgctgtaccacggtggaggcgtgtatatcattgacgtgtctcagtccgtggagcacgaccacccacatgccttggagttcttgagaaaggattgcgccaacgtcaatgatttctttatgaggcacagtgttgctgtcatgactgtgcgggagctctttgaatttgtcacagatccatccattacacatgagaacatggatgcttatctctcaaaggccatggaaatagcatctcaaaggaccaaggaagaacggtctagccaagatcatgtggatgaagaggtgtttaagcgagcatatattcctagaaccttgaatgaagtgaaaaattatgagagggatatggacataattatgaaattgaaggaagaggacatggccatgaatgcccaacaagataatattctataccagactgttacaggattgaagaaagatttgtcaggagttcagaaggtccctgcactcctagaaaatcaagtggaggaaaggacttgttctgattcagaagatattggaagctctgagtgctctgacacagactctgaagagcagggagaccatgcccgccccaagaaacacaccacggaccctgacattgataaaaaagaaagaaaaaagatggtcaaggaagcccagagagagaaaagaaaaaacaaaattcctaaacatgtgaaaaaaagaaaggagaagacagccaagacgaaaaaaggcaaatagaatgagaaccatattatgtacagtcattttcctcagttccttttctcgcctgaactcttaagctgcatctggaagatggcttattggttttaaccagattgtcatcgtggcactgtctgtgaagacggattcaaatgttttcatgtaactatgtaaaaagctctaagctctagagtctagatccagtcactgactctgtctggtgttgacagaggatttatttaagctattattttaataaagaactttgtacatttttatttttatatttttttctcttacaaatatgtttttggaagcatgataaatgtttaaatgtagtcaacatctgtaactcttacatgagtgtccagaggcactcatgggaaaattggttttgctttctttgtacacaccagagacccatctgaggtcatctgattataaggccatgtttatataaagggaatttcacccacagttcagctggctgttgattttcactgcaactctgcctttgtgtgtattggcgatcatttgtaatgctcttacacttcgtctttaatgttctttttggagttaggacctctcagttcataaagttttttacaattcaa

SEQ ID NO: 177585 - DNA, 960 bp, Homo sapiens
  Payload ID: 14845
  Gene Symbol: RIOK1
  Gene Name: RIO kinase 1
  ENST ID: ENST00000475351
  CDS Start-End: 211-498
gggcgaggcggtgaggggcttccggttggggtggcagggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtcatggactaccggcggcttctcatgagccgggtggtccccgggcaattcgacgacgcggactcctctgacagtgaaaacagagacttgaagacagtcaaagagaaggatgacattctgtttgaagaccttcaagacaatgtgaatgagaatggtgaaggtgaaatagaagatgaggaggaggagggttatgacgatgatgatgatgactgggactgggatgaaggagttggaaaactcgccaagggttatgtctggaatggaggaagcaacccacagctagtgccttagactctggaattcccttctaggcaaatcgacagacctccgacagcagttcagccaaaatgtctactccagcagacaaggtcttacggaaatttgagaataaaattaatttagataagctaaatgttactgattccgtcataaataaagtcaccgaaaagtctagacaaaaggaagcagatatgtatcgcatcaaagataaggcagacagagcaactgtagaacaggtgttggatcccagaacaagaatgattttattcaagatgttgactagaggaatcataacagagataaatggctgcattagcacaggaaaagaagctaatgtataccatgctagcacagcaaatggagagagcagagcaatcaaaatttataaaacttctattttggtgttcaaagatcgggataaatatgtaagtggagaattcagatttcgtcatggctattgtaaaggaaacccta

SEQ ID NO: 177586 - DNA, 3922 bp, Homo sapiens
  Payload ID: 14846
  Gene Symbol: RIOK2
  Gene Name: RIO kinase 2
  Uniprot ID: Q9BVS4
  ENST ID: ENST00000283109
  CDS Start-End: 70-1728
ggaataacgacctgccttacgctttgcggctgtcgtcggagaggcatctgggttcggactggggccgccatggggaaagtgaatgtggccaagttgcgttacatgagccgagatgacttcagggtcttgaccgcggttgaaatgggcatgaagaaccatgaaattgttcccggcagtttgattgcttctatagccagccttaaacatggtggctgtaataaagttttaagagaattagtgaaacataaactcatagcttgggagcgtaccaaaactgtccagggctatcggttgacaaatgcaggatatgattacctagctttgaaaacactttcttctaggcaagtagttgagtctgttggaaaccagatgggtgttggcaaagaatcagatatttacattgttgcaaatgaagaaggacaacaatttgcattaaagcttcacagactaggaagaacctcgtttcgaaatttgaaaaacaaacgcgattatcataaacataggcacaatgtgtcatggctatatttatctcgtctctctgccatgaaggaatttgcctatatgaaggcattgtatgagaggaaatttccagttccaaagccaattgattacaatcgtcatgcagtggtcatggaactcataaatggttatccactatgtcagatacaccatgttgaagatcctgcatcagtatatgatgaagctatggaactaattgtcaaacttgcaaatcatgggctgattcatggagattttaatgaatttaatctcattttggatgaaagtgaccatatcaccatgattgattttccacagatggtttcaacttctcatcccaatgctgagtggtattttgacagagatgttaaatgcattaaagatttctttatgaaacgtttcagctacgaaagtgagctttttccaacttttaaggatatcaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacgggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcagagatgaagaaaatgtgggagctatgaatcagtatagaacaagaactctgagtatcacttcttcaggcagtgctgtaagctgttcaacaattcctccagaactggtgaaacagaaggtgaaacgtcagttgacaaaacagcaaaaatcagctgtcagacgtcgattgcagaaaggagaagcaaatatatttaccaagcaacgtagggaaaacatgcaaaatatcaaatcaagtttggaagcagccagcttttggggagaataatatatttaggatcttggatatgtttaatatattttttaaagttactgtaattcctttttgagccctcatttgtcttttttgagccaaggctatcatatattaataaataaaccctctttcatctataaatttggtcattcagtatgtgtcttgcaaagaataattacctgccaaagcagtccatttttttcaaagtaatttgggtaactacagttacgtaactttattagagacatttgcatatttttaaaaatctaaataacatttttgttgttttctgtttgttgaggatgatatgctacaatgcacataaagcaattagaacaatgtttagcacattcttaagcattcaataaaacatggctattagaatcataatgattctgaaattctgctgacaatttggttgcattttatttggcaactggaggacttcactgtcttatttttctttagaagtaaagataagcctttggaagtaaagataagccagtgatgcacaatttgcttaattaattgattaataatctgttttgtgccacttacattggtaatgtggtcatgagaatggaaacttacttgagatagtctaccacaatttttacagttggcagcttgtaagcaggcctgagtagcagaagagttaggggttggggaaggtggagtagaatgaggaatgaaatgttctttctcatatgcttattatataagtgggtccggaacatgttctcacctcaaggttaacaaatacctaatgcaggaaagaaaatacatagccatggtcccttcctcaaggactttataattcagtgagatgtaaagatgagtgcttaagtgtatgcacctgattattgtctcttcattgccgcataagtcggaaaaggggatcacttgcagcgaaaaatggccactagatggcaatatcaccccatagtcaccaaacaggattacttgcatccctaattatgttctaccagagggaatatagtacagacttttccaagattgataaagacagcagattccctttcacctttgccaaattaactctactagctatttgcaagacctgtaattatctaataaattggcttaaatatatagaagctagaaaatgccaattcctcttccctcaaaagttacctgacattcaaatatttaaatacccttgctttgcattttagatatatctttgaattcaggtattcattttgtataatctctcaacttttaagcatttttataatgtaaagttgaaaacagcttaatagaaccacagaatgtttattttggagtcattttcttatattcagagctatgaaagcaaattgggaataaagccttatcctgctcagctttacctagttgactcagttgacttttgagtatctactacataaaaagcccattactattaagaaactcaagacaaacatgatttttacctttaatagcctaagatttcttgtgggccaaggaattaattattccaatcagaaatggaggccttacctcatttgggcaaagattagtgctagttattgaagatttactaataaatgatctgttaaggaatttagttttttttggatatgttgttttggttgttgaaaactaaggtataattataatagttattttttgaagatatgtttggctagccatcaattagaagttagagagtttgtcctaacagataagctataaccctcacattttaaaacatgcatagtgaacaatgaacaaaaacaaattcaaaattttactaatgtaaagctgtatattgtgattgttaaaacacttttttttgcctaggagttccagatttaaatcctggttctacacttcccaaacctcaggtaccttctgtggcctctctaacctcaatttttttacttgtaaaatggggacatttaatagtatacctcagtgtcgtgaagactaaatgaagtaccacttgtaaagagtttattacagtgcctgacatatactgtatggttagtactgctaaaatgacttcttaaggttaccaaaaggaaaattccacaagctgaccacctttcctattgtgatggtcactggtatttcagctatgatcctttgttgtgtatttatccagactgaaagatgtttttctagtaaccatcttgcatcgtcttagtctccccattaaataaacttttcctacaaacta

SEQ ID NO: 177587 - DNA, 2149 bp, Homo sapiens
  Payload ID: 14846
  Gene Symbol: RIOK2
  Gene Name: RIO kinase 2
  Uniprot ID: Q9BVS4
  ENST ID: ENST00000508447
  CDS Start-End: 32-1456
gagaggcatctgggttcggactggggccgccatggggaaagtgaatgtggccaagttgcgttacatgagccgagatgacttcagggtcttgaccgcggttgaaatgggcatgaagaaccatgaaattgttcccggcagtttgattgcttctatagccagccttaaacatggtggctgtaataaagttttaagagaattagtgaaacataaactcatagcttgggagcgtaccaaaactgtccagggctatcggttgacaaatgcaggatatgattacctagctttgaaaacactttcttctaggcaagtagttgagtctgttggaaaccagatgggtgttggcaaagaatcagatatttacattgttgcaaatgaagaaggacaacaatttgcattaaagcttcacagactaggaagaacctcgtttcgaaatttgaaaaacaaacgcgattatcataaacataggcacaatgtgtcatggctatatttatctcgtctctctgccatgaaggaatttgcctatatgaaggcattgtatgagaggaaatttccagttccaaagccaattgattacaatcgtcatgcagtggtcatggaactcataaatggttatccactatgtcagatacaccatgttgaagatcctgcatcagtatatgatgaagctatggaactaattgtcaaacttgcaaatcatgggctgattcatggagattttaatgaatttaatctcattttggatgaaagtgaccatatcaccatgattgattttccacagatggtttcaacttctcatcccaatgctgagtggtattttgacagagatgttaaatgcattaaagatttctttatgaaacgtttcagctacgaaagtgagctttttccaacttttaaggatatcaggagagaagacactcttgatgtggaggtttctgccagtggctacacaaaggaaatgcaggcagatgatgaactgcttcatccattaggtccagatgataaaaatattgaaacaaaagagggatctgaattctcattttcagatggagaagtggcagaaaaagcagaggtttacgggtcagaaaatgaaagtgaacggaactgtctagaagaatcagagggctgctattgcagatcatctggagaccctgaacaaataaaggaagacagtttatcagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcaggtatagacttctgtcgattgctttttaactttagtcttgagactgatactttgttagattctagtaaaagaatgtttttttcaaatgatgtgacaaaattgtattctgccaccttgatgtataaaatgaaagccaaataattttttgttgttaaaaactcaaaatagcttccttttcaattgacctgattctaggcagcctattgactaaatttcaagtaattctgccttaaaatacaaactgatggctgggcacagtggctcgctcatgcctgtaatctcagcacttctgggaggccaaggcaggcaaatcacctgaggtcaggagtttgagaccagccaggccaacatggcaaaaccctgtctctactaaaaatataaaaattaaccgggcatggtggcctgtgcttgtaatcccagctacttgggagactgaggcaggagaatcacttgaacctgggaggcagaggttgcagtaagccaaagatcgtaccactgcactccagcctgggtgacgagcaaaaaactccgtctcaaaaatatatatatatatacaaactgatgattttaaaattattgcaggtctctggatacattgatcaggttttagatggatgagttattcctcatatattttcctaattacacatctgatgtgtgtttgagttatgtaaaggcatgtaaatattaaaacatgcaataaatgtactttctatatgaaa

SEQ ID NO: 177588 - DNA, 603 bp, Homo sapiens
  Payload ID: 14846
  Gene Symbol: RIOK2
  Gene Name: RIO kinase 2
  ENST ID: ENST00000511293
  CDS Start-End: 1-478
agatggtcagagagttcaaggaggagtccctgctggctctgacgagtatgaagatgaatgccctcatctaattgccttgtcgtcattaaatagagaattcaggcctttcagctgtgtatctgtgtcacagggctactgccatttaaataataaacttggaaaattaaatcagaagcttaaaaggaaaagaggggtgacagaggctcaggattttgaagatgaagaaaatgtgggagctatgaatcagtatagaacaagaactctgagtatcacttcttcaggcagtgctgtaagctgttcaacaattcctccagaactggtgaaacagaaggtgaaacgtcagttgacaaaacagcaaaaatcagctgtcagacgtcgattgcagaaaggagaagcaaatatatttaccaagcaacgtagggaaaacatgcaaaatatcaaatcaagtttggaagcagccagcttttggggagaataatatatttaggatcttggatatgtttaatatattttttaaagttactgtaattcctttttgagccctcatttgtcttttttgagccaaggctatcatatattaataaataaaccctctttcatcta

SEQ ID NO: 177589 - DNA, 442 bp, Homo sapiens
  Payload ID: 14846
  Gene Symbol: RIOK2
  Gene Name: RIO kinase 2
  ENST ID: ENST00000511012
  CDS Start-End: 1-422
cagaagagagtgctgatgcacggagttttgaaatgactgaattcaatcaagctttagaagaaataaaagggcaggttgttgaaaacaactctgtaactgaattttctgaggagaaaaacagaactgaaaattacaacaggcaagatggtcagagagttcaaggaggagtccctgctggctctgacgagtatgaagatgaatgccctcatctaattgccttgtcgtcattaaatagagaattcaggcctttcagagatgaagaaaatgtgggagctatgaatcagtatagaacaagaactctgagtatcacttcttcaggcagtgctgtaagctgttcaacaattcctccagtaagtagtcattcaacatgtactgaatgtttattacatcactactgtgatctgattgccttgtctcattaaacaataatgtatgcctttca

SEQ ID NO: 177590 - DNA, 493 bp, Homo sapiens
  Payload ID: 14846
  Gene Symbol: RIOK2
  Gene Name: RIO kinase 2
  ENST ID: ENST00000510384
  CDS Start-End: 52-165
acgctttgcggctgtcgtcggagaggcatctgggttcggactggggccgccatggggaaagtgaatgtggccaagttgcgttacatgagccgagatgacttcagggtcttgaccgcggtaagaaacccgccgttcctgttctcccttccccttaacactgtgtgacctcttcctgttcctgcaagttttctgggatctgagcaggcacactctgggacccgggacgtggcagaagctgggaatggagaagagagcattcagaaagtcggatttttaaaaaggttttgtttgggagcttaccttcccccagatagagcaaaggtcccgtcttctaataattgttttcttttctgctgctattcgctttgcgctgaagagaaacgcttgcatctctgtggcctggaaacttctctgatcctgagcttccgaccagctgtgaaaggttgaaatgggcatgaagaaccatgaaattgttcccggcagtttgattgct

SEQ ID NO: 177591 - DNA, 4038 bp, Homo sapiens
  Payload ID: 14847
  Gene Symbol: RIOK3
  Gene Name: RIO kinase 3
  Uniprot ID: O14730
  ENST ID: ENST00000339486
  CDS Start-End: 618-2177
aacaacaaccaccacaaactccgaccgtcctttccaggccctttccctctataaacctgccgttttctgtctcccaagtcatcccagtttagaactgctccaggaaataatgaatgaacagagagagcctagtttgtttatttatttacaatccactagtctaatctagtttagatccagcggcaatttttggggtgccaaggaggaaagaaggagatggcagtgcggggacagggcagagcctgggccaaaggaagccacacccagttcttgccctgccctgcccgacacaggcaacgtgaccccaagcgacagccagctgatgcttgcttctccgagcccggcggtcagcagccggaagtagcccgcccgggggcggggaaaggtgccttaaggaggagctaggggcgtgcggccaattgcaagcgactgtcctagcgaagagggcggaagaggagagatccagttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactgctgtgtggcattcttggagtgtgctgtgaatgtgctttttaagaaattaaaaagagatcattttaaaattg

SEQ ID NO: 177592 - DNA, 1904 bp, Homo sapiens
  Payload ID: 14847
  Gene Symbol: RIOK3
  Gene Name: RIO kinase 3
  Uniprot ID: O14730
  ENST ID: ENST00000577501
  CDS Start-End: 133-1683
cgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataa

SEQ ID NO: 177593 - DNA, 685 bp, Homo sapiens
  Payload ID: 14847
  Gene Symbol: RIOK3
  Gene Name: RIO kinase 3
  ENST ID: ENST00000577250
  CDS Start-End: 1-270
atcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgaggttacagcaactccatgtaaagatgatggtgatgcaaggatttcagccaattcctgtctcagcatgggactctcctgctaatgcagcctgggatccttagaccagcagccagagatttccaatcctttggtaggcagggccagcgcccttaaatcagcaagaagacgacacagatgactgacctcctccctcatcaacccttaagaataagggatggaaatctctgaagggggaatgagataggaagatcactgggtgctcgcaagaggatggaagaatccacacaagagcttaaacaagagctaggcaaagaaactgtgggataacagaaaacccaaaatcaggaggagaaggctgggtttggtggctcatgactgtaatcccagcactgtgggaggctgaggagggcagatcacctgaggtcaggagttcgagaccagcctgtgcaatatggtgaaaccccttctctaccaaaaatacaaaaaaaaaaaaaaaa

SEQ ID NO: 177594 - DNA, 1966 bp, Homo sapiens
  Payload ID: 14847
  Gene Symbol: RIOK3
  Gene Name: RIO kinase 3
  ENST ID: ENST00000581585
  CDS Start-End: 154-1665
agttccggacgcggccgccgccgtcgccgccatctgtcacctccactccggcatcagcagccagtcgcccgtgtcccgcctgtctcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataat

SEQ ID NO: 177595 - DNA, 591 bp, Homo sapiens
  Payload ID: 14847
  Gene Symbol: RIOK3
  Gene Name: RIO kinase 3
  ENST ID: ENST00000584130
  CDS Start-End: 1-406
tgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagt

SEQ ID NO: 177596 - DNA, 1172 bp, Homo sapiens
  Payload ID: 14848
  Gene Symbol: RIPPLY1
  Gene Name: ripply transcriptional repressor 1
  Uniprot ID: Q0D2K3
  ENST ID: ENST00000276173
  CDS Start-End: 31-486
ggagaccccactggctttggtcccctaagaatggactctgctgcctgtgctgctgctgccacccctgttccagccctggctttggccctagctccagacctagcacaagccccactggcactccctggcctgttaagcccatcttgccttctctcctctggacaagaagtaaatgggagtgaaagaggaacttgtctctggaggccctggctgtcttccacaaatgactccccaaggcagatgaggaagctggtggatttggctgctggtggggcaacggctgctgaggtcaccaaggctgaatccaagttccatcaccctgtcaggctcttctggcctaaatcccgctccttcgactatctgtacagtgctggggagattttactgcagaactttcctgtccaggcaaccatcaacctatacgaggactcagacagcgaagaagaagaggaagatgaagagcaggaggatgaagaagagaagtaggaggccaatgaaaaggggccagaagggtgtgtgagggtaccagggtccataccctacagcgccacagctcatcccccttcctcacccctaacctatccaaatggaggcagccagagtctgattggggttcagtttgtctggcaagttttcacagacatcagttagccggaagtattagtccagcagatagagctttctggactgaaaattgggtcatctagctgcccagctcaccctggcttacctgaatggcctgtgagctcaggcctcttgcatctcattgtctgggctgctgttgtgttgaccatgggagggttctaggagctctagaaggaaggcttgctgaagcccccaggaagcagagcagggcagggaatgcccttgtggagggaagtagtcattcctcaggccctttgactccctagccttcccaggtggccatgtagtcccgtctctctgtggaaagcctgacttctggcttcaccccaaggaataccaacagcagatccatgcaaggttggggtgcctttttgatgagtcttacaggaagggaaggcagtgtgtagagaatcggcttgctctggggatgcctccccattttgcctgctgtccattgaagtctgtgtgttggcatgagatgaatcaggagaaaaataaactggatggtgttttcctttttcttggaa

SEQ ID NO: 177597 - DNA, 786 bp, Homo sapiens
  Payload ID: 14848
  Gene Symbol: RIPPLY1
  Gene Name: ripply transcriptional repressor 1
  Uniprot ID: Q0D2K3
  ENST ID: ENST00000411805
  CDS Start-End: 49-363
agaaggttctgggaagtaggagaccccactggctttggtcccctaagaatggactctgctgcctgtgctgctgctgccacccctgttccagccctggctttggccctagctccagacctagcacaagccccactggcactccctggcctgttaagcccatcttgccttctctcctctggacaagaagtaaatgggagtgaaaggctcttctggcctaaatcccgctccttcgactatctgtacagtgctggggagattttactgcagaactttcctgtccaggcaaccatcaacctatacgaggactcagacagcgaagaagaagaggaagatgaagagcaggaggatgaagaagagaagtaggaggccaatgaaaaggggccagaagggtgtgtgagggtaccagggtccataccctacagcgccacagctcatcccccttcctcacccctaacctatccaaatggaggcagccagagtctgattggggttcagtttgtctggcaagttttcacagacatcagttagccggaagtattagtccagcagatagagctttctggactgaaaattgggtcatctagctgcccagctcaccctggcttacctgaatggcctgtgagctcaggcctcttgcatctcattgtctgggctgctgttgtgttgaccatgggagggttctaggagctctagaaggaaggcttgctgaagcccccaggaagcagagcagggcagggaatgcccttgtggagggaagtagtcattcctcaggccctttgactccct

SEQ ID NO: 177598 - DNA, 521 bp, Homo sapiens
  Payload ID: 14849
  Gene Symbol: RIPPLY2
  Gene Name: ripply transcriptional repressor 2
  Uniprot ID: Q5TAB7
  ENST ID: ENST00000369687
  CDS Start-End: 183-395
ctctccatcccccactgcccggtgccagcgctcggcttcggtggattctcccgggtctgggctcacgtctcctctgcgcgccttgtgctcccctatcccgcagatacgcaggcttctggagaccctgggtggacgccggaggcaagaaagaagaggagacgccgaaccacgccgcggaggcgatgcccgatggccctggaatgaccgcagcctcaggaaagctttaccaattcaggcacccagtcagactattttggccaaaatcaaaatgttatgattacttatatcaagaagcagaagctcttctgaaaaattttccaattcaagccacaatttcattttatgaagattctgatagcgaagatgaaattgaggatctgacctgtgaaaattaatctgattagctacttttgattatatccaaagcttgtggggtttaaatttagtgtacaaatgtatcataattattttaaactaatttatttgtatataaattattaataaaatgaaatattttgtaa

SEQ ID NO: 177599 - DNA, 664 bp, Homo sapiens
  Payload ID: 14849
  Gene Symbol: RIPPLY2
  Gene Name: ripply transcriptional repressor 2
  Uniprot ID: Q5TAB7
  ENST ID: ENST00000369689
  CDS Start-End: 152-538
gcggctagcagggagaggggcggagaggcagcgaacctctcaatgtgcagcaggccgcgagggctatataaagctcgggtctcggacctactggaactggtcaagattgcccgcgagctggcagcggccttccgcccagctctgcggcgtcatggagaacgcgggaggcgcagagggtacagagagtggagctgcggcgtgcgcggccaccgacggccctacgcggcgcgcgggcgcggactccggatacgcaggcttctggagaccctgggtggacgccggaggcaagaaagaagaggagacgccgaaccacgccgcggaggcgatgcccgatggccctggaatgaccgcagcctcaggaaagctttaccaattcaggcacccagtcagactattttggccaaaatcaaaatgttatgattacttatatcaagaagcagaagctcttctgaaaaattttccaattcaagccacaatttcattttatgaagattctgatagcgaagatgaaattgaggatctgacctgtgaaaattaatctgattagctacttttgattatatccaaagcttgtggggtttaaatttagtgtacaaatgtatcataattattttaaactaatttatttgtatataaattattaataaaatgaaatattttgtaa

SEQ ID NO: 177600 - DNA, 2235 bp, Homo sapiens
  Payload ID: 14850
  Gene Symbol: RIPPLY3
  Gene Name: ripply transcriptional repressor 3
  Uniprot ID: P57055
  ENST ID: ENST00000329553
  CDS Start-End: 211-783
ctccgacccgggcttttccttcgtaccctgcggccccctccgcacccctcacggagctcctcgggtcctgccccctcccagcgcttgcccgcgccgccccgcccccgtttttaaacctggcgcgcgggtaggtgagcgcgttagcccgagtggatctaggcgcgctcgtaggccggcgccgcagcaaggggcgcgggctccgccggcaccatggagcccgaagcggcggccggagcccggaaggcgcgggggcgcggctgtcactgccccggggacgctccctggaggcctccgccaccgcgcgggccggagagccccgcgccgtggcgaccttggatccagacacctggagatgctgagctgaccagaactggaaggccgcttgaacctagggctgaccaacacacttttggatcaaagggagcctttgggtttcagcatcctgtaagagtctatttacccatgtcaaagcgtcaagaatacctgcggagttccggggagcaagtactggccagtttcccagtgcaagccacgattgacttctacgacgatgagtctactgagtctgcttccgaagctgaagagccagaggaaggacccccacccctccatcttctgccccaggaggtgggaggtcggcaggaaaatggcccagggggaaagggcagagaccagggcatcaaccaagggcagcgatcctcaggagggggtgaccactggggggagggtccgctccctcaaggtgtctcctcaaggggtggcaagtgctcctcatccaaatgaatcagtctctgtctcctgggccctgctctgggacctgcccctcacgttctcttggggacacccgagccaggacactacgcatccctgctgagtgtgcagaggctagaggcttctcgggcagcccctggcctgcacactactcatgacagaaagtcagcttttacttttctttcccctggcaattcgtttttggtgcactcatgcatgcctttgagaaaggattctaggagaaagagaaggtctatgtcaacagagttgttatctcatagagccagttttcaaagctccttctgcattgtcactcactgatcaggtgatgaattcttcctagatagtcgcccactccacctcctacttaacctgagactcattatttagctatttctgcttttgtaaaaataattcagatattaaactccaattttaatctatcatccaagggtagatgtagttgcttagtagcattttggaaaaaaaagaaaaaaaggtttggtttggttttgtgacggagttttgctcttgtctcccaggctggagtgcagtgacacaatctcggctcactgcaacctccacttcttgggttcaagtgattctcctgtctcagcctcccaagtagctgggattacaggcatgagctaccacgcctggctaattttttgtatttttagtagagactcggtttcaccatgttggtcaggctggctttgaactcctgacctcaggtgatccacccgccttggcctcccaaagtgctgggattacaggcgtgagccactgagcccggccaaaaaaaaatgtatttattaaaaaaaaatttttttaacccgccgaataattcccataagagtaacaaaaaggaccagcctgaccaacgtggagaaactctgtctctactaaaaatacaaaattagccaggcgtgatggctcatgcctgtaatcccagctactcgggaggctgaggcaggagaatggctagaacccgggaggcggaggttgccgtgagtcgagatcgcaccattgcattccagcctgggcaacaagagcgaaactccgtctcaaaaaaaaaaaaaaaaaaaaagaaagaaaagagtaacagaaagatagggatttttaggagacaattagataaaaatgtatgtgatgactgtataaggaggcctgtgtgtatgaatttatagggagtagaaccgtctctcttcttagttggtgactgtttggggcctggtattttaatagatgaacactacttttttaattttttatttttttaaccctacccttaacccatgaacactatttttaattaaagtatctgatgtaaaattattttgagtttttaatattttgataaacgtgtattcctgaaactttttgacttacttatcttacatgtggtgtcttcctgtatatagtacattatatcaatttctacttgaaataaatattttgaaa

SEQ ID NO: 177601 - DNA, 6051 bp, Homo sapiens
  Payload ID: 14851
  Gene Symbol: RNMT
  Gene Name: RNA (guanine-7-) methyltransferase
  Uniprot ID: O43148
  ENST ID: ENST00000262173
  CDS Start-End: 45-1475
agtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttatgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtcgtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccgttattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagaccaccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctg

SEQ ID NO: 177602 - DNA, 6250 bp, Homo sapiens
  Payload ID: 14851
  Gene Symbol: RNMT
  Gene Name: RNA (guanine-7-) methyltransferase
  Uniprot ID: O43148
  ENST ID: ENST00000383314
  CDS Start-End: 241-1671
agtgacgtaagcagacacgcgtggcgcgggccgccgtttccgcaaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttatgtgaactgttgtccttgctttacaccaccatttggaaaacttaccagtttttagatgtagatgtagtgaaaaacttcaagaatgaagcagagcaattgagtattcttttttaaattattaagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtcgtctaaatgttcggtattctattcaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccgttattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagaccaccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctgaca

SEQ ID NO: 177603 - DNA, 1849 bp, Homo sapiens
  Payload ID: 14851
  Gene Symbol: RNMT
  Gene Name: RNA (guanine-7-) methyltransferase
  Uniprot ID: O43148
  ENST ID: ENST00000543302
  CDS Start-End: 113-1543
aagtgacgtaagcagacacgcgtggcgcgggccgccgtttccgcaaacagaatcgcgtttggctgtgctgtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaa

SEQ ID NO: 177604 - DNA, 4108 bp, Homo sapiens
  Payload ID: 14851
  Gene Symbol: RNMT
  Gene Name: RNA (guanine-7-) methyltransferase
  Uniprot ID: O43148
  ENST ID: ENST00000592764
  CDS Start-End: 198-1712
aaacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacacttggaaattgagggagcatgaccgctctctgacttcacatgttaatagaggatcagagcagagttgggagtatattggtcaggatcatagaaaagaagacaaagcttgctcagccatgagatggccaggtatccagttttgttaactctctttgggaatttctttttcagcctgttttttagcttagtgccattatgtcattttgatttgtattcaagtactcttcaagtatctttgtaatgaaggtttggctacttgtataggtctgcctgcagggtgaaaatgccagtgtgaatattctagctaccaaacattgttttttgttgaaaaactgactttctgttgtctacctcaggccttgtgcatttgggttatctcaagccagtcaccacagagggtctctagggtctgcaaaatagaggccaaatccagggaccaggccctaataatagaagttgtaccaaaatgcctgtggtacttgatggcctgttggtcaaataggaagtacaagtgtgtgatgttagaacctccctagttgctgctatatcaaacactgcacacttgacaagtgttttcattccccgccctctgacagaacaacattcctaattctttgaaggcaaccagtgcaaaggctactacacttgtgtaatgatatttagcagatgcatacaggactggatcccagggcactgtcagttcttccctccctctcgtgctgctcagtttgtcctctgctcccatgtaggcctaaagtcaccccactccttagtgcctgcacctcaccacgatattgaggaagcacaggacatccaagggtactctccagtttggctgtggagacttgagcaagccctaaagtcccctgctccctggacttctcctgggttgtgcttttttgggggcaacataccttggacaaagctgagctgacagctaatgtttattagcctcctacctaagtcagtcactttgctaaattcttcacctgtggtaactcattttgattgttataacatctcagcaccgttattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagaccaccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctga

SEQ ID NO: 177605 - DNA, 1879 bp, Homo sapiens
  Payload ID: 14851
  Gene Symbol: RNMT
  Gene Name: RNA (guanine-7-) methyltransferase
  Uniprot ID: O43148
  ENST ID: ENST00000589866
  CDS Start-End: 361-1791
gatgcccttagtgtccataggccaaaagaaatataacagttccatttattaagtagtttaccccaaagaatttaaaagtatttatggtctaacaactttatgtctgtttaaaaaattaacacacataaattggggggaaaggtaatgtttctgttttattcttgattaatcacaatcccttactaacaggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaaaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtct

SEQ ID NO: 177606 - DNA, 1612 bp, Homo sapiens
  Payload ID: 14851
  Gene Symbol: RNMT
  Gene Name: RNA (guanine-7-) methyltransferase
  ENST ID: ENST00000588457
  CDS Start-End: 181-1077
gtaagcagacacgcgtggcgcgggccgccgtttccgcaaacagaatcgcgtttggctgtgctgaatctggaagaaggacacagctcaacagtggctgcccattacaatgaacttcaggaagttggtttggagaagcgtagtcaaagtcgtattttttacctaagaaactttaataattggatgaaaagtgttctcattggagaatttttggaaaaggtacgacagaagaaaaaacgtgatatcactgttttggacctgggatgtggtaaaggtggagatttgctgaaatggaaaaaaggaagaattaacaagctagtttgtactgatattgccgatgtttctgtcaaacagtgtcagcagcggtatgaggacatgaaaaatcgtcgtgatagtgaatatattttcagtgcagaatttataactgctgacagctcaaaggaacttctgattgacaaatttcgtgacccacaaatgtgttttgacatctgcagttgtcagtttgtctgtcattactcatttgagtcttatgagcaggctgacatgatgctgagaaatgcgtgtgagagacttagccctgggggctattttattggtactactcccaatagctttgaattgataagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgaaatggcaaagaagtacaatatgaaactagtctacaaaaaaacatttctggaattctacgaagaaaagattaagaacaatgaaaataaaatgctcttaaaacgaatgcaggccttggagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagtatttacttggtgtttgcctttgagaaacagcagtgagcacataggcagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggc

SEQ ID NO: 177607 - DNA, 572 bp, Homo sapiens
  Payload ID: 14851
  Gene Symbol: RNMT
  Gene Name: RNA (guanine-7-) methyltransferase
  ENST ID: ENST00000591746
  CDS Start-End: 269-572
gtgtttgtccctcggccgccgtggaggggtggaactggcactcccacccctgacatgggctcacttcgcattagccctgtgcttcactacccaacgcgatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaatt

SEQ ID NO: 177608 - DNA, 811 bp, Homo sapiens
  Payload ID: 14851
  Gene Symbol: RNMT
  Gene Name: RNA (guanine-7-) methyltransferase
  ENST ID: ENST00000593007
  CDS Start-End: 1-344
tctacgaagaaaagattaagaacaatgaaaataaaatgctcttaaaacgaatgcaggccttggaggactttcatttctttccccagccatatcctgcaaatgagagttctaaacttgtctctgagaaggtggatgactatgaacatgcagcaaagtacatgaagaacagtcaagtaaggttacctttgggaaccttaagtaaatcagaatgggaagctacaagacttacggtaactattatgagggaggcatggctttccaccgtcgggccaggaagagcacctgttgctgcaagctcagtgaagtggggcactcccagacctgccatgcagtttatcctctgagaatggaattggaaatgaagacctaaccagctattggtgggaatgacggaactggggattgcgatgattgatctgggaacatggctggattgtgatttaaccaagaatgctgatgttgaattctttgggcctagaatatacttgagaaagcactagtggcttgtgttcagggagaggagctggcagtttttaaccacttctgtgggagccgtgttctaacctgtggaaagtattgcaattctgtgagagtgactctgcagagtcactgcaccatcaggcttggccctgctgtgccttcagtacccagccaggttctctgggtccagggtgactctccaaagaaattggccttcagctggagaaaacattgggtggagactctcacttatgttaatgcaatcttgaaatgactgaaaggtagattgccagcacagtgagtttcccagcctgctcccccatccacactt

SEQ ID NO: 177609 - DNA, 2027 bp, Homo sapiens
  Payload ID: 14852
  Gene Symbol: RTCB
  Gene Name: RNA 2',3'-cyclic phosphate and 5'-OH ligase
  Uniprot ID: Q9Y3I0
  ENST ID: ENST00000216038
  CDS Start-End: 100-1617
gcgctttggttcttggaaggcggtgctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaaagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggctttcgccaaggtcttcaacacaacccctgatgacttggacctacatgtgatctatgatgtttctcacaacattgccaaagtggagcagcatgtggtggacggaaaggaacggacactgttagtacacaggaagggatccacccgcgctttccctcctcaccatcccctcattgctgttgattaccaactcactggacagccagtgctcattggtggcaccatgggaacctgtagttatgttcttactggcactgaacagggcatgactgagacctttggaacaacctgtcatggagcgggccgtgcattgtcccgagcaaaatctcgacgtaatttagatttccaggatgtcttagacaaattggcagatatgggaattgcgatccgtgttgcctcacccaaactggttatggaagaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtt

SEQ ID NO: 177610 - DNA, 1534 bp, Homo sapiens
  Payload ID: 14853
  Gene Symbol: RTCA
  Gene Name: RNA 3'-terminal phosphate cyclase
  Uniprot ID: O00442
  ENST ID: ENST00000260563
  CDS Start-End: 128-1267
tcgtcaggctcctgcgccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgagttctggaggctggaagtccaagatcaaggtcctgacaaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctga

SEQ ID NO: 177611 - DNA, 538 bp, Homo sapiens
  Payload ID: 14853
  Gene Symbol: RTCA
  Gene Name: RNA 3'-terminal phosphate cyclase
  ENST ID: ENST00000370126
  CDS Start-End: 88-237
gaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggtaaatctggctggagggggagttgggccgtgaagctgggggatcggggggtcgggctgccgggctggggcatcgggagtccgagtggtggaacccagaaggtcccagacgcaggtatgggcgatccagggcggggcactctgcctgggcggtggcctgggttgtaaagtcttgaaagcctggaggggtgagtttagaaatggtctcgagttttctctgtttgactaaatagtgtcatttgctgaagagctagcttttaaaatgttttctcacctcaccgggcattccaaatatccgaacagcac

SEQ ID NO: 177612 - DNA, 2535 bp, Homo sapiens
  Payload ID: 14853
  Gene Symbol: RTCA
  Gene Name: RNA 3'-terminal phosphate cyclase
  Uniprot ID: O00442
  ENST ID: ENST00000370128
  CDS Start-End: 170-1270
gctgactccagtgtcccgagaggcgccgcttcttccgctttctcgtcaggctcctgcgccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgaagtaaatacatttttcttttttatgtaattaattaaatcagggatatagatttgatctgtaatttgggtataattctaatctttgctgaaatcacatctcaagtataatgaggcaactttatgcaaatgtacttgttgtgacaacaataacattttccttttttttttttttttttgagacagtctcgttctgtcacccaggctggggtgctgtggtgtgatcttggctcactgcaacctctgcctcccgggttcaagcaattctactgcctcagcttcctgagtagttggtattacaccaccatgcccagctaatttttgtatttttagtagagacagggtttcaccatattggtcaggctggtttcgaactcctgacctcgtgatctgcccgcctcggcctcccaaagtggtgggattacaggcgtgagccagtgcacccggcaacaataacatttaataggcattgtctcattctaatgatatataccttctacctagtgggcactttgtacatatttattttttattttatttattcattttttttgagacagagtctcactctgtcaccaagttggagtgcagtggcacaatctcagctcactgcaacctccgccttccaggttgaagtgattctccagcctcagcctcccgagtagctgggactccaggcacgtaccaccatacccagataatttttgcatttttagtagagacggggtttcaccatgttggctaggatggtctccatctcctgacctcgtgatccgcccaccttggcctcccaaagtgctgggattacaggcatgagccaccacagctggtcgtaaatattttttgaatttgaatctgttttggaagccaaatatgttttggaagccaaacaattaagagaagtaaaattttaaccctagtaggtttcgcagattcatccccagatatgtttttgtttggcttgtgttattaacaaataaatgagtgtctttcaaatggaa

SEQ ID NO: 177613 - DNA, 1884 bp, Homo sapiens
  Payload ID: 14854
  Gene Symbol: RBM3
  Gene Name: RNA binding motif (RNP1, RRM) protein 3
  ENST ID: ENST00000354480
  CDS Start-End: 288-755
tggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaa

SEQ ID NO: 177614 - DNA, 1130 bp, Homo sapiens
  Payload ID: 14854
  Gene Symbol: RBM3
  Gene Name: RNA binding motif (RNP1, RRM) protein 3
  Uniprot ID: P98179
  ENST ID: ENST00000376755
  CDS Start-End: 230-703
atgcgcaatgtggccccctaatggtggctgcgctgagccagctcctcagattaccaccttattggccgcctttctcagcttttctgtagttacccatattttgttcctctttcttgtctattttctgtgctttttctctgctttccgtctcgctattttctcacatctccattttctttctccttcctgccaccattcttcatgttcttcccacaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataag

SEQ ID NO: 177615 - DNA, 2162 bp, Homo sapiens
  Payload ID: 14854
  Gene Symbol: RBM3
  Gene Name: RNA binding motif (RNP1, RRM) protein 3
  Uniprot ID: P98179
  ENST ID: ENST00000376759
  CDS Start-End: 64-537
gctcctccgagctcgctgttcgtccgggttttttacgttttaatttccaggacttgaactgccatgtcctctgaagaaggaaagctcttcgtgggagggctcaactttaacaccgacgagcaggcactggaagaccacttcagcagtttcggacctatctctgaggtggtcgttgtcaaggaccgggagactcagcggtccaggggttttggtttcatcaccttcaccaacccagagcatgcttcagttgccatgagagccatgaacggagagtctctggatggtcgtcagatccgtgtggatcatgcaggcaagtctgctcggggaaccagaggaggtggctttggggcccatgggcgtggtcgcagctactctagaggtggtggggaccagggctatgggagtggcaggtattatgacagtcgacctggagggtatggatatggatatggacgttccagagactataatggcagaaaccagggtggttatgaccgctactcaggaggaaattacagagacaattatgacaactgaaatgagacatgcacataatatagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatacaaaagttagcggggcgtggtggcgggtgcatgtaatcccagctactcgggaggctgaggcaggagaattgcttgaacccaggaggcggaagttgcagtgagctgagattgtgccactgcactccagcctaggtgacagcaagactctgtctcaaaaaaaaaaaaatggcacatcaacgagagggaggcttggagaatatttggttggtgggtgggcagggactgccagagggttaggtgtacattgaggcctgaggcctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatc

SEQ ID NO: 177616 - DNA, 3201 bp, Homo sapiens
  Payload ID: 14855
  Gene Symbol: RBM10
  Gene Name: RNA binding motif protein 10
  ENST ID: ENST00000329236
  CDS Start-End: 1-2988
atgtctgggagcccttccttgacagcccgggccgagaaggtgagcgtcgacgctggtcgtgggggcggagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgc

SEQ ID NO: 177617 - DNA, 3108 bp, Homo sapiens
  Payload ID: 14855
  Gene Symbol: RBM10
  Gene Name: RNA binding motif protein 10
  Uniprot ID: P98175
  ENST ID: ENST00000345781
  CDS Start-End: 333-2894
gtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggagatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 177618 - DNA, 3747 bp, Homo sapiens
  Payload ID: 14855
  Gene Symbol: RBM10
  Gene Name: RNA binding motif protein 10
  Uniprot ID: P98175
  ENST ID: ENST00000377604
  CDS Start-End: 743-3535
gccaaccattttcggccaggctgagaaatttcttattgatgggtctgctcatttcctgcataggaagaaatcggtgacatttgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctg

SEQ ID NO: 177619 - DNA, 3105 bp, Homo sapiens
  Payload ID: 14855
  Gene Symbol: RBM10
  Gene Name: RNA binding motif protein 10
  Uniprot ID: P98175
  ENST ID: ENST00000628161
  CDS Start-End: 333-2891
gtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacgtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggagatccgtggccagctgcagtcgcacggcgtgcaagcacgggaggttcggctgatgcggaacaaatcttcaggtcagagccggggcttcgccttcgtcgagtttagtcacttgcaggacgctacacgatggatggaagccaatcagcactccctcaacatcctgggccagaaggtgtcgatgcactacagtgaccccaagcccaagatcaatgaggactggctgtgcaataagtgtggcgtccagaacttcaaacgccgagagaagtgcttcaaatgtggcgtgcccaagtcagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacaccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgaggcagcccagctgctgcagatcctgcaggccctgcacccaccactcactatcgacggcaagaccatcaatgttgagtttgccaagggttctaagagggacatggcctccaatgaaggcagtcgcatcagtgctgcctctgtggccagcactgccattgctgcggcccagtgggccatctcacaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccagtcgtataccatcatgtcacccgctgtgctcaaatctgagctccagagccctacccatcctagttctgctctcccaccggctaccagccccactgcccaggaatcctacagccagtaccctgttcccgacgtctctacctaccagtacgatgagacctccggctactactatgacccccagaccggcctctactatgaccccaactcccagtattactacaatgctcagagccagcagtacctgtactgggatggggagaggcggacctatgttcccgccctggagcagtcggccgacggacataaggagacaggggcaccctcgaaggagggcaaagagaagaaggagaagcacaagaccaagacagctcaacagattgccaaggacatggaacgctgggcccgcagtctcaacaaacaaaaagaaaacttcaaaaatagcttccagcctatcagctccctgcgagatgacgagaggcgggagtcagccactgcagatgctggctatgccatcctcgagaagaagggagcactagccgagagacagcacaccagcatggatctcccgaaattggccagtgacgaccgcccaagccctccgcgaggactggtggcagcctacagcggggagagtgacagtgaggaggagcaggagcgtgggggccctgagcgggaggagaagctcaccgactggcagaagctggcctgtctgctctgccgacgccagttccccagcaaagaggcgctcatccggcaccagcagctctcagggctccacaagcaaaaccttgagattcaccggcgagcccacttgtcagaaaacgagctagaagcactagagaagaatgacatggagcaaatgaagtaccgggaccgtgcagctgaacgcagagaaaagtatggcatccccgagccgccagagcccaagaggaggaagtacggcggcatatccacagcctctgtagacttcgagcagcctactcgggacgggctgggcagtgacaacattggcagtcggatgctgcaggccatgggctggaaagagggcagcggcctgggccgcaagaagcagggcattgtaacgcctatcgaggcccaaacacgggtgcggggctccggcctgggtgcacggggcagctcctacggggtcacctcaaccgagtcctacaaggagacactgcacaagacaatggtgacccgcttcaacgaggcccagtgagcagcttcaagagcaacttctccacatgttgggtgtccatcctggggcagggaaggacagagtgttggatggctgggacggggccttgctcttgtcggccagcccactccccagccagagagggcttgaccaaatcaaattgaggtggtgacttttgttggaaaattgggctgggatcacgtcctgttttgtaataaaagctgaaaagtctgca

SEQ ID NO: 177620 - DNA, 1934 bp, Homo sapiens
  Payload ID: 14856
  Gene Symbol: RBM11
  Gene Name: RNA binding motif protein 11
  Uniprot ID: P57052
  ENST ID: ENST00000400577
  CDS Start-End: 10-855
gaccggaggatgttccctgctcaggaggaggccgacaggaccgtgtttgttgggaatttagaggcccgagttcgggaagagattctgtacgagctgttccttcaggcggggccactaaccaaagtgactatatgcaaagacagagaaggaaagccaaagtcttttggatttgtctgctttaaacacccagaatcggtgtcttatgccatagctttgctgaatggaattcgtttatatggaagaccaattaacgtgcagtatcgatttgggagttctcgctcttctgaaccagctaaccaaagttttgagagctgtgttaagataaattcacacaactacaggaatgaagaaatgttggtgggcagatcttcctttcccatgcagtattttccaattaataatacttctttacctcaagaatattttctctttcagaagatgcagtggcatgtgtataatccagtgctgcagcttccttactatgaaatgacagctccacttcctaatagtgcatccgtgtcttcctcactgaatcatgttccagatcttgaggctggacccagctcatataaatggactcaccaacaaccaagtgactctgacctttatcagatgacagctccacttcctaatagtgcatccgtgtcttcctcactgaatcatgttccagatcttgaggctggacccagctcatataaatggactcaccaacaaccaagtgactctgacctttatcagatgaataaacgaaagagacaaaagcaaacaagtgatagtgatagtagcacagacaacaacagaggcaacgaatgtagccaaaagttccgaaagtctaagaagaagaaaagatactagtattacctacaaatgaaacttacctacactgatcttagttctcttatgaaaaaaataagatgttatcccatcaaataaacaatgtcatggctatcttgtcttttgaaatatgtagtaataagacttatctctggtttgctgttcaatttttgccttgaacgacaaaagctttctaaaaatagtataatgtaccactttttgtatttgtcatgatatttttgacccattggcaacaaatagactattgtcattttattagtaccaatgatgaaatttcaccaaactattaatcaaaagtcacttattgaacacattgataaagcatcatgttccctttgattatcccctataaccaacactcaactacaaataggctgggattcaatgtggagtggtggatttcctgaaagaaagtagtgcagatatttaaggattgcatattgttcctaatgaggatgtaataaacaggcattagtacccctttcttttagtacctaaatatgttgtttctgagccatattcttcttcaggtttattttataaagtgaggacatatgataatgataccaaaggaaagataattatcatgaaaccaacttttggatcattccctttttatacaattgtgtatttatagggataccttcctcttctcacatattaattgtatgtcattaaaatcagttggctatgtcagtgtgtattattcacctcttttgctagcaaggtttgagatgctatattaacatttaaatcatgaaaatgagcaagtaaatagaataatattttattaatgtatgatatgtaatacttattgtctaaatcaagtttcctatttttggtttatttattttagaagaaaaataaaattatttgggcatttttgtttatagctcattacaaactagagtgatgaatatatatatttactaaagctaattgaaagagtcatgcaactcagttgggaattaaccactcaattcaatagtaaaagccatgcttggatgtttcttttgcatgttgcctagcattttatagatatttattatttaaaaaaataaagatatgtttttaatgaa

SEQ ID NO: 177621 - DNA, 5332 bp, Homo sapiens
  Payload ID: 14857
  Gene Symbol: RBM12
  Gene Name: RNA binding motif protein 12
  Uniprot ID: Q9NTZ6
  ENST ID: ENST00000359646
  CDS Start-End: 152-2950
ggcgaaggaggtggtggctgcgttgggctccgggaagccgttcgggctggggctgtcggccgcggggcggaggcactcgcgcggggggtaattcggggtctgggttctggtgccgcgcagctttccccggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttg

SEQ ID NO: 177622 - DNA, 5213 bp, Homo sapiens
  Payload ID: 14857
  Gene Symbol: RBM12
  Gene Name: RNA binding motif protein 12
  Uniprot ID: Q9NTZ6
  ENST ID: ENST00000374104
  CDS Start-End: 217-3015
attttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacacttta

SEQ ID NO: 177623 - DNA, 6662 bp, Homo sapiens
  Payload ID: 14857
  Gene Symbol: RBM12
  Gene Name: RNA binding motif protein 12
  Uniprot ID: Q9NTZ6
  ENST ID: ENST00000374114
  CDS Start-End: 265-3063
gagcgggccgacggccattttgtgaagcggcgaaggaggtggtggctgcgttgggctccgggaagccgttcgggctggggctgtcggccgcggggcggaggcactcgcgcggggggtaattcggggtctgggttctggtgccgcgcagctttccccgtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcagagcagtgtgaagccactccccatcaaccctgatgatctgtatgtcagtgtgcatggaatgcccttttctgcaatggaaaatgatgtcagagatttttttcatgggctccgtgttgatgcagtgcatttgttgaaagatcatgtaggtcgaaataatgggaatggattggttaagtttctctcccctcaagatacatttgaagctttgaaacgaaacagaatgctgatgattcaacgctatgtggaagttagccctgccacagaaagacagtgggtagctgctggaggccatatcacttttaagcaaaatatgggaccttctggacaaactcatccccctcctcagacacttcccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggacactaaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaaacaggctgatgcttttaatgctttaactgca

SEQ ID NO: 177624 - DNA, 583 bp, Homo sapiens
  Payload ID: 14857
  Gene Symbol: RBM12
  Gene Name: RNA binding motif protein 12
  ENST ID: ENST00000431148
  CDS Start-End: 154-583
aaccacgccgttcctcccccttctggaacgcggagccgctgagcgggccgacggccattttgtgaagcggcgaaggaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagca

SEQ ID NO: 177625 - DNA, 1068 bp, Homo sapiens
  Payload ID: 14857
  Gene Symbol: RBM12
  Gene Name: RNA binding motif protein 12
  ENST ID: ENST00000424458
  CDS Start-End: 196-1068
cggcgaaggaggtggtggctgcgttgggctccgggaagccgttcgggctggggctgtcggccgcggggcggaggcactcgcgcgggggtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgggggcttcctttgggagcccaacgtttagctcaactgttccaagcacagcctctccaatgaacacagtcccgccgccaccaattcctccaattccagcgatgccatctctgccaccaatgccatccattcccccaattccagttcctcctccagtacctacattgcctcctgtgcctcctgtgcccccgattcccccagttccttctgtgccacccatgaccccactgccacccatgtcgggcatgccgcccttgaatccgccacctgtggcacctctacctgctggaatgaatggctctggagcacctatgaatttgaacaataatctgaatcctatgtttcttggtccgttgaatcctgttaaccctatccagatgaactctcag

SEQ ID NO: 177626 - DNA, 565 bp, Homo sapiens
  Payload ID: 14857
  Gene Symbol: RBM12
  Gene Name: RNA binding motif protein 12
  ENST ID: ENST00000435161
  CDS Start-End: 164-565
ctggaacgcggagccgctgagcgggccgacggccattttgtgaagcggcgaaggagtctaaaagttggttttaattggttgcccacaggattgacttggcctctacttcttgttaaggaaattcatctcttgttttatcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagtt

SEQ ID NO: 177627 - DNA, 7269 bp, Homo sapiens
  Payload ID: 14858
  Gene Symbol: RBM12B
  Gene Name: RNA binding motif protein 12B
  Uniprot ID: Q8IXT5
  ENST ID: ENST00000399300
  CDS Start-End: 215-3220
gtccgtttgtccggaccggaggggcagtgggcgccatcttcttctgggctcactgagggtctacctgttttggggaggctgctgcgacgaagagttccctcagcctccggccttgtgtgtccgactcggcagcagtgttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaaataatggtgatgccatagtaaaatttgcttcatgtgttgatgcttcaggaggtcttaaatgtcatagaagttttatgggttcaagatttatagaagtaatgcaaggatcagaacaacagtggattgagtttggtggtaatgcagttaaggagggtgacgttcttaggagatctgaagaacattctccaccaagaggaattaatgatagacattttcgaaaacggtctcattcaaaatctcccagaagaacacgttctcgttcccctcttggattttatgttcacttaaaaaatctgtccctcagtattgacgaaagagatttaagaaatttctttagaggtactgatctgactgatgaacagattaggtttttatataaagatgaaaatagaacaagatatgcctttgtgatgttcaagactctgaaagactataataccgctctgagtttacataagactgttttacaatatcgtccagttcatattgatccaatttctagaaaacaaatgctgaagttcattgcacgttatgaaaagaagagatcagggtcactagagagagataggcccggacatgtttcacaaaaatactctcaagaaggtaactctggccagaaactgtgcatctatataagaaattttccatttgatgttacaaaagttgaagtgcagaagttctttgcagactttcttcttgctgaggatgacatttacttgctttatgatgacaaaggtgttggtctgggagaagcattagtgaaatttaaatcagaagaacaggccatgaaagctgaacgtttaaaccgacgaagattcctagggacagaggtgttattaagacttatatctgaggcacaaatacaggagtttggtgtaaatttttctgtgatgtccagtgaaaaaatgcaagctcgctcacagtcacgtgagcgaggtgaccattcccatttatttgactcaaaagacccaccaatatactcagttggtgcttttgaaaactttagacatcagctagaggacttgaggcaactggataacttcaagcatccccagagggatttccggcagcctgacaggcaccctccagaagacttccgacactcctcagaggactttaggttccccccggaggacttcaggcactccccagaggacttcaggcgacctagggaggaagacttcaggcggccttctgaggaggacttcaggcgcccttgggaggaagatttcaggcgccctccggaggatgacttcaggcaccctagggaggaggactggaggaggccccttgaggaggactggaggcggccactggaggaggatttcaggcggtctcccacggaggacttcaggcagctccccgaggaggacttcaggcaaccccctgaggaggacttaaggtggctcccagaggaagatttcaggcggccacctgaggaggactggagacggcccccagaggaggactttaggcggcctcttcagggagaatggaggcgaccacccgaggatgacttcaggcggcccccagaggaggatttcaggcattcccctgaggaggacttcaggcagtcaccccaggagcatttccggaggccacctcaggagcatttccgtcggccacccccagagcatttccggagaccacctccagagcattttaggcggcctcccccagagcacttccggcggccacccccagagcacttcaggcggccacccccagagcatttcaggcgcccgcccccggagcacttccggagaccgccccaggagcatttcaggcggccgcctcaggagcatttcaggcgctcccgagaggaagatttcaggcacccaccagatgaagacttcaggggccctcctgatgaagactttaggcaccctcctgatgaggacttcaggagcccccaggaggaagattttagatgcccttctgatgaggacttcaggcagctcccagaggaagaccttagggaagctccggaggaggaccctagacttcctgacaattttagacctcctggtgaggattttaggagcccgcctgatgattttagaagtcaccgcccttttgtgaattttggtcgcccagaaggtggcaagtttgattttggaaagcataatatgggaagttttcctgaggggagatttatgcctgatccaaaaataaattgtggttcaggtagagtaactcctattaagataatgaatcttccatttaaagctaatgtgaatgaaattttagactttttccatggttacagaatcatacctgattcagtttcgatacagtataatgagcaaggcttacctacaggggaagccattgttgctatgataaactataatgaagctatggctgctattaaagatctaaatgataggccagttgggccccgaaaagttaagttaactttgctgtagagagagagcatttctaaattcagttatcttccttgcagtattgatggagtaaaatacatttgttttaaaaaagtgttttttttttaaattatctaatgaaatattttatttttgacctgtgaatagaacaaatgtaaatagtagaatgtgaatctggttttcttttgcttgcaaattgccattctttttttttttcaaatttaaaattacacatgctgtttttttctttgatggggagaaagaactcattccctgagttcattcatttttgttgatgtcatcggtaatcttcaagacttattgaagtagagttgtatttggggaagatacattttatattcacttttttttttctttctgtagtctacctcttttactcaaactgtataaggaaatagtgactgattgttcaggtttggcattttcattgctacctgcctgcagaattaatgccctcttccttgtctaagatattactgtgttaagtgtcctgttaattataaatagttcaaaatggacagactgtcaacttgaaatttacttatgtaaaaagcttaggtgattcttagggtttccatgttcataactttacaaagctttataaaaataaaattgcaacttaatagagctaattaacttgtatttgtataaaaagaaaaaagaattgcagctcgatattgtgaagtttttcaataacttcattaaaccatatttatgatgggagggaccagacattctatagtaataatgtatagtgctgtgtataattccatggtttcttcaacatcttatcaaccaagtaaaattaatacaagatacgcaaaagatagtaaaataagaatctaattataggtgcaaggggactcaggcttatgctggaagaatctgacaagtggtatagtttgtttttctaggaagaatttactgatgagtcacataacttgcatgtaatattaggttctcattttttagcttcgaaactgtgtccatgcaaagactctataactgttaagacttgtgtggttgaattttgacttctttgatattcagcatttagtgcatacattttgcaactagggaatttgattttctatacccacaataatatttatggctaacatttattaggcacttactatgtgctaggcactgtaagcactttacatgcataatctcggtattccctgtgagtacagggttaattatttacctctatttcacaaatgagataatgaagtgggatgaagtgcgaggttaagcaacttgcttgaagtcataggtagtaaatcgtggggccaattttaacccagacagaccactgactccagttcatgcttttgctgcctcacttttttaagtggtatttttaattaggaagaccatgctaaagatactttcaaggataaatgattattttctcacttcaattgttggtttaaaattagcataaataggtaaaaccagcatgctcaaacactgagctcaaacattaacattactaataaaaaaaaaaagagtgactttaaaagtttctttctatccagggtttctcttgggatactcatatggtatattactggcttatatttcaaaattattttattcaacatgattgactttggccttttataatttacataaaacataattttcctcagttctgtaatccagattttccccattgagtaaataatacaattaaatttacatatggtaatttagacatttaataggatattgcataggtagaatactttgtcagtacttagttactacctatatgtatttttgtgttacttttcagtgatttaaagaaatctaacagaaatctgcttaaatttgttttaaatagtgaatatcctgcttgctatggaatgaataaacaggtaaatttgatatgaaaaagcacctcagtatgattctttaaagtataagcttgtaagtagctaggataatgttaaattgattgtttggaatatccaaaccaagcacaatgaagaaagtagaaatgatatttttaattgagcaaagattgtatagatggttcatttggtcacccattttgaataatatatggaaagttaaaaaatgcttctcagatacaaaggaataaagctaagatgaagcttaacgtgagggattacttactgtggaattgcatttcaaactgggctgaggtgggatggtggtggtagataagaggccagctagagtaaacataagctttgtagttttattattttaagagtcagagtcttgttctgctggccaggctggagtgcagtggtctgataatggttcactgcagcttctaactcctgggctcaagctgtcttcctgcctcagcctcctgagagctgggactacaggtgtgtgccaccttgtctggctaaattttttattatttgtagagacagagtctcactgtgttgcccaggctgttctcaaatttctggcctcaagcaatcctcactccttggtctcccagaatgtgttgggattacaggtgtgagccactgtgcccagccttgtattttgatttttaaattaatttatatgaatatttccttttaccctataatgtatcagggcttaatatttttaaacttcattataaaaagttgattacagaaagtggtatcttctagttgggagccatctttgcacatctctctccaactctgcctttagtgatatgtcaataacaaattggccatggcaggagtattttacaccatggaaagtgataaatgcagcaaatcaaggaattcccctcctgttgtcccctcagaaagccagcttcccagcacctcatcaatttcaaatataaaaaaagaatagtaaattttcatgtacacatcactcagcttcagtaattgtcgtctcatagccagtttttcctctcctatcctcaaggtataccaggtacactggaggtgtattctctagcctgatacccagtggcatttgtcttaaagccaaacatttttgtctagaaattatctaaaaaaatgtagatcatgtctagaaagtcaatcccacaaccaagagataggtaaaaatcatgttaggagtgcatttctattaatttactgagatcactgttaagagcagtgattcttgatccatatatcacctgttaagtagtgaccttgctgcctctgtttttgcagtaaatattagctgttgtttattgagctgtattagatactatatgatgtataattatgtatgaattaactatcatttaattctgataatcctagtaaatgtactacaggttgagtattcctaatctggtaatctgaaatttcacatgctccgaaaatcacaaactttttgagtgccaacatgatgctcaaagaaaatgctcattgcagcatttaagatttcagatttttgggttaggaatgttgaactggtataatgcaaatactccaaaatctgaagaaatccaaagtcttaaatacttctggtcccaagcacttcagataaaggatactcaatttgtattcctattttggagataagagatggagacttacaggctgggttggttggattggttgcctgttttttgttgttgttgtagtggaagctaggaatggtttttcacattttttaagtgtacttaagtcttacatggttacatagttacctgtataatagtcttgaatttgcctaaacccacgaagaataacagtatttgctatctggccctttaagaagtttgccaacctaggctggtctaaataatgaaaattttacattaatgaaagtattttcatggatagtattccttttgttcttagaatatttctttgaggtaggcagaatgtatgttttattccagaattactgttttacgcagttttaactttacaaacaaggcaaataatgctcaagagaagttgctatttagtaagcagcaaaataataactctgttgttttcccccgaagtacaaccaaatttaaatactgagtgaggaagcagtaaatatccaatgatatcttgagtttcttaagaatatcaatttagggttttaaa

SEQ ID NO: 177628 - DNA, 6001 bp, Homo sapiens
  Payload ID: 14858
  Gene Symbol: RBM12B
  Gene Name: RNA binding motif protein 12B
  ENST ID: ENST00000517700
  CDS Start-End: 215-2860
gtccgtttgtccggaccggaggggcagtgggcgccatcttcttctgggctcactgagggtctacctgttttggggaggctgctgcgacgaagagttccctcagcctccggccttgtgtgtccgactcggcagcagtgttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaaataatggtgatgccatagtaaaatttgcttcatgtgttgatgcttcaggaggtcttaaatgtcatagaagttttatgggttcaagatttatagaagtaatgcaaggatcagaacaacagtggattgagtttggtggtaatgcagttaaggagggtgacgttcttaggagatctgaagaacattctccaccaagaggaattaatgatagacattttcgaaaacggtctcattcaaaatctcccagaagaacacgttctcgttcccctcttggattttatgttcacttaaaaaatctgtccctcagtattgacgaaagagatttaagaaatttctttagaggtactgatctgactgatgaacagattaggtttttatataaagatgaaaatagaacaagatatgcctttgtgatgttcaagactctgaaagactataataccgctctgagtttacataagactgttttacaatatcgtccagttcatattgatccaatttctagaaaacaaatgctgaagttcattgcacgttatgaaaagaagagatcagggtcactagagagagataggcccggacatgtttcacaaaaatactctcaagaaggtaactctggccagaaactgtgcatctatataagaaattttccatttgatgttacaaaagttgaagtgcagaagttctttgcagactttcttcttgctgaggatgacatttacttgctttatgatgacaaaggtgttggtctgggagaagcattagtgaaatttaaatcagaagaacaggccatgaaagctgaacgtttaaaccgacgaagattcctagggacagaggtgttattaagacttatatctgaggcacaaatacaggagtttggtgtaaatttttctgtgatgtccagtgaaaaaatgcaagctcgctcacagtcacgtgagcgaggtgaccattcccatttatttgactcaaaagacccaccaatatactcagttggtgcttttgaaaactttagacatcagctagaggacttgaggcaactggataacttcaagcatccccagagggatttccggcagcctgacaggcaccctccagaagacttccgacactcctcagaggactttaggttccccccggaggacttcaggcactccccagaggacttcaggcgacctagggaggaagacttcaggcggccttctgaggaggacttcaggcgcccttgggaggaagatttcaggcgccctccggaggatgacttcaggcaccctagggaggaggactggaggagaccacctccagagcattttaggcggcctcccccagagcacttccggcggccacccccagagcacttcaggcggccacccccagagcatttcaggcgcccgcccccggagcacttccggagaccgccccaggagcatttcaggcggccgcctcaggagcatttcaggcgctcccgagaggaagatttcaggcacccaccagatgaagacttcaggggccctcctgatgaagactttaggcaccctcctgatgaggacttcaggagcccccaggaggaagattttagatgcccttctgatgaggacttcaggcagctcccagaggaagaccttagggaagctccggaggaggaccctagacttcctgacaattttagacctcctggtgaggattttaggagcccgcctgatgattttagaagtcaccgcccttttgtgaattttggtcgcccagaaggtggcaagtttgattttggaaagcataatatgggaagttttcctgaggggagatttatgcctgatccaaaaataaattgtggttcaggtagagtaactcctattaagataatgaatcttccatttaaagctaatgtgaatgaaattttagactttttccatggttacagaatcatacctgattcagtttcgatacagtataatgagcaaggcttacctacaggggaagccattgttgctatgataaactataatgaagctatggctgctattaaagatctaaatgataggccagttgggccccgaaaagttaagttaactttgctgtagagagagagcatttctaaattcagttatcttccttgcagtattgatggagtaaaatacatttgttttaaaaaagtgttttttttttaaattatctaatgaaatattttatttttgacctgtgaatagaacaaatgtaaatagtagaatgtgaatctggttttcttttgcttgcaaattgccattctttttttttttcaaatttaaaattacacatgctgtttttttctttgatggggagaaagaactcattccctgagttcattcatttttgttgatgtcatcggtaatcttcaagacttattgaagtagagttgtatttggggaagatacattttatattcacttttttttttctttctgtagtctacctcttttactcaaactgtataaggaaatagtgactgattgttcaggtttggcattttcattgctacctgcctgcagaattaatgccctcttccttgtctaagatattactgtgttaagtgtcctgttaattataaatagttcaaaatggacagactgtcaacttgaaatttacttatgtaaaaagcttaggtgattcttagggtttccatgttcataactttacaaagctttataaaaataaaattgcaacttaatagagctaattaacttgtatttgtataaaaagaaaaaagaattgcagctcgatattgtgaagtttttcaataacttcattaaaccatatttatgatgggagggaccagacattctatagtaataatgtatagtgctgtgtataattccatggtttcttcaacatcttatcaaccaagtaaaattaatacaagatacgcaaaagatagtaaaataagaatctaattataggtgcaaggggactcaggcttatgctggaagaatctgacaagtggtatagtttgtttttctaggaagaatttactgatgagtcacataacttgcatgtaatattaggttctcattttttagcttcgaaactgtgtccatgcaaagactctataactgttaagacttgtgtggttgaattttgacttctttgatattcagcatttagtgcatacattttgcaactagggaatttgattttctatacccacaataatatttatggctaacatttattaggcacttactatgtgctaggcactgtaagcactttacatgcataatctcggtattccctgtgagtacagggttaattatttacctctatttcacaaatgagataatgaagtgggatgaagtgcgaggttaagcaacttgcttgaagtcataggtagtaaatcgtggggccaattttaacccagacagaccactgactccagttcatgcttttgctgcctcacttttttaagtggtatttttaattaggaagaccatgctaaagatactttcaaggataaatgattattttctcacttcaattgttggtttaaaattagcataaataggtaaaaccagcatgctcaaacactgagctcaaacattaacattactaataaaaaaaaaaagagtgactttaaaagtttctttctatccagggtttctcttgggatactcatatggtatattactggcttatatttcaaaattattttattcaacatgattgactttggccttttataatttacataaaacataattttcctcagttctgtaatccagattttccccattgagtaaataatacaattaaatttacatatggtaatttagacatttaataggatattgcataggtagaatactttgtcagtacttagttactacctatatgtatttttgtgttacttttcagtgatttaaagaaatctaacagaaatctgcttaaatttgttttaaatagtgaatatcctgcttgctatggaatgaataaacaggtaaatttgatatgaaaaagcacctcagtatgattctttaaagtataagcttgtaagtagctaggataatgttaaattgattgtttggaatatccaaaccaagcacaatgaagaaagtagaaatgatatttttaattgagcaaagattgtatagatggttcatttggtcacccattttgaataatatatggaaagttaaaaaatgcttctcagatacaaaggaataaagctaagatgaagcttaacgtgagggattacttactgtggaattgcatttcaaactgggctgaggtgggatggtggtggtagataagaggccagctagagtaaacataagctttgtagttttattattttaagagtcagagtcttgttctgctggccaggctggagtgcagtggtctgataatggttcactgcagcttctaactcctgggctcaagctgtcttcctgcctcagcctcctgagagctgggactacaggtgtgtgccaccttgtctggctaaattttttattatttgtagagacagagtctcactgtgttgcccaggctgttctcaaatttctggcctcaagcaatcctcactccttggtctcccagaatgtgttgggattacaggtgtgagccactgtgcccagccttgtattttgatttttaaattaatttatatgaatatttccttttaccctataatgtatcagggcttaatatttttaaacttcattataaaaagttgattacagaaagtggtatcttctagttgggagccatctttgcacatctctctccaactctgcctttagtgatatgtcaataacaaattggccatggcaggagtattttacaccatggaaagtgataaatgcagcaaatcaaggaattcccctcctgttgtcccctcagaaagccagcttcccagcacctcatcaatttcaaatataaaaaaagaatagtaaattttcatgtacacatcactcagcttcagtaattgtcgtctcatagccagtttttcctctcctatcctcaaggtataccaggtacactggaggtgtattctctagcctgatacccagtggcatttgtcttaaagccaaacatttttgtctagaaattatctaaaaaaatgtagatcatgtctagaaagtcaatcccacaaccaagagataggtaaaaatcatgttaggagtgcatttctattaatttactgagatcactgttaagagcagtgattcttgatccatatatcacctgtt

SEQ ID NO: 177629 - DNA, 579 bp, Homo sapiens
  Payload ID: 14858
  Gene Symbol: RBM12B
  Gene Name: RNA binding motif protein 12B
  ENST ID: ENST00000518597
  CDS Start-End: 150-579
cggaggggcagtgggcgccatcttcttctgggctcactgagggtctacctgttttggggaggctgctgcgacgaagagttccctcagcctccggccttgtgtgtccgactcggcagcagtggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggc

SEQ ID NO: 177630 - DNA, 588 bp, Homo sapiens
  Payload ID: 14858
  Gene Symbol: RBM12B
  Gene Name: RNA binding motif protein 12B
  ENST ID: ENST00000520560
  CDS Start-End: 222-588
tacctgttttggggaggctgctgcgacgaagagttccctcagcctccggccttgtgtgtccgactcggcagcagtgcttccatgtggtggtgtatgtgcgcttcccagggatcttgagagtgaagatctcgaaggatttcatagttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatg

SEQ ID NO: 177631 - DNA, 452 bp, Homo sapiens
  Payload ID: 14858
  Gene Symbol: RBM12B
  Gene Name: RNA binding motif protein 12B
  ENST ID: ENST00000521947
  CDS Start-End: 205-452
gggcgccatcttcttctgggctcactgagggtctacctgttttggggaggctgctgcgacgaagagttccctcagcctccggccttgtgtgtccgactcggcagcagtggtgtgtgtttattgccaattaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactat

SEQ ID NO: 177632 - DNA, 615 bp, Homo sapiens
  Payload ID: 14858
  Gene Symbol: RBM12B
  Gene Name: RNA binding motif protein 12B
  ENST ID: ENST00000519109
  CDS Start-End: 168-615
ccgactcttcctttcccgtcagcttccatgtggtggtgtatgtgcgcttcccagggatcttgagagtgaagatctcgaaggatttcatagttaagttgcttttacagagttaacaggtctccaagaaattttaaaaaaggtcattattgctgtggtttgagctcagcatggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccat

SEQ ID NO: 177633 - DNA, 2646 bp, Homo sapiens
  Payload ID: 14858
  Gene Symbol: RBM12B
  Gene Name: RNA binding motif protein 12B
  ENST ID: ENST00000627241
  CDS Start-End: 1-2646
atggctgtagtcatccgtttactggggcttccttttattgcggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaaataatggtgatgccatagtaaaatttgcttcatgtgttgatgcttcaggaggtcttaaatgtcatagaagttttatgggttcaagatttatagaagtaatgcaaggatcagaacaacagtggattgagtttggtggtaatgcagttaaggagggtgacgttcttaggagatctgaagaacattctccaccaagaggaattaatgatagacattttcgaaaacggtctcattcaaaatctcccagaagaacacgttctcgttcccctcttggattttatgttcacttaaaaaatctgtccctcagtattgacgaaagagatttaagaaatttctttagaggtactgatctgactgatgaacagattaggtttttatataaagatgaaaatagaacaagatatgcctttgtgatgttcaagactctgaaagactataataccgctctgagtttacataagactgttttacaatatcgtccagttcatattgatccaatttctagaaaacaaatgctgaagttcattgcacgttatgaaaagaagagatcagggtcactagagagagataggcccggacatgtttcacaaaaatactctcaagaaggtaactctggccagaaactgtgcatctatataagaaattttccatttgatgttacaaaagttgaagtgcagaagttctttgcagactttcttcttgctgaggatgacatttacttgctttatgatgacaaaggtgttggtctgggagaagcattagtgaaatttaaatcagaagaacaggccatgaaagctgaacgtttaaaccgacgaagattcctagggacagaggtgttattaagacttatatctgaggcacaaatacaggagtttggtgtaaatttttctgtgatgtccagtgaaaaaatgcaagctcgctcacagtcacgtgagcgaggtgaccattcccatttatttgactcaaaagacccaccaatatactcagttggtgcttttgaaaactttagacatcagctagaggacttgaggcaactggataacttcaagcatccccagagggatttccggcagcctgacaggcaccctccagaagacttccgacactcctcagaggactttaggttccccccggaggacttcaggcactccccagaggacttcaggcgacctagggaggaagacttcaggcggccttctgaggaggacttcaggcgcccttgggaggaagatttcaggcgccctccggaggatgacttcaggcaccctagggaggaggactggaggagaccacctccagagcattttaggcggcctcccccagagcacttccggcggccacccccagagcacttcaggcggccacccccagagcatttcaggcgcccgcccccggagcacttccggagaccgccccaggagcatttcaggcggccgcctcaggagcatttcaggcgctcccgagaggaagatttcaggcacccaccagatgaagacttcaggggccctcctgatgaagactttaggcaccctcctgatgaggacttcaggagcccccaggaggaagattttagatgcccttctgatgaggacttcaggcagctcccagaggaagaccttagggaagctccggaggaggaccctagacttcctgacaattttagacctcctggtgaggattttaggagcccgcctgatgattttagaagtcaccgcccttttgtgaattttggtcgcccagaaggtggcaagtttgattttggaaagcataatatgggaagttttcctgaggggagatttatgcctgatccaaaaataaattgtggttcaggtagagtaactcctattaagataatgaatcttccatttaaagctaatgtgaatgaaattttagactttttccatggttacagaatcatacctgattcagtttcgatacagtataatgagcaaggcttacctacaggggaagccattgttgctatgataaactataatgaagctatggctgctattaaagatctaaatgataggccagttgggccccgaaaagttaagttaactttgctgtag

SEQ ID NO: 177634 - DNA, 2828 bp, Homo sapiens
  Payload ID: 14859
  Gene Symbol: RBM14
  Gene Name: RNA binding motif protein 14
  Uniprot ID: Q96PK6
  ENST ID: ENST00000310137
  CDS Start-End: 140-2149
attggctaggccagggcgcctgcgcggcggggttctcggtcgccagccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctg

SEQ ID NO: 177635 - DNA, 1426 bp, Homo sapiens
  Payload ID: 14859
  Gene Symbol: RBM14
  Gene Name: RNA binding motif protein 14
  Uniprot ID: Q96PK6
  ENST ID: ENST00000393979
  CDS Start-End: 96-566
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaagactacgcgtttgttcacatggagaaggaagcagatgccaaagccgcaatcgcgcagctcaacggcaaagaagtgaagggcaagcgcatcaacgtggaactctccaccaagggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaa

SEQ ID NO: 177636 - DNA, 876 bp, Homo sapiens
  Payload ID: 14859
  Gene Symbol: RBM14
  Gene Name: RNA binding motif protein 14
  ENST ID: ENST00000409372
  CDS Start-End: 92-571
attcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggagatgtgaagatttttatcctgtgttgcagttcatctttgctccttcttctctcaccaggaagttggactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcc

SEQ ID NO: 177637 - DNA, 372 bp, Homo sapiens
  Payload ID: 14859
  Gene Symbol: RBM14
  Gene Name: RNA binding motif protein 14
  Uniprot ID: Q96PK6
  ENST ID: ENST00000409738
  CDS Start-End: 7-366
gacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggtatggttccgaccggcgtttagccgagc

SEQ ID NO: 177638 - DNA, 732 bp, Homo sapiens
  Payload ID: 14859
  Gene Symbol: RBM14
  Gene Name: RNA binding motif protein 14
  ENST ID: ENST00000443702
  CDS Start-End: 76-465
gccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaagccctgcacggccacgagctgcggccggggcgcgcgctcgtggtggagatgtcgcgcccaaggcctcttaatacttggaagattttcgtgggcaatgtgtcggctgcatgcacgagccaggaactgcgcagcctcttcgagcgccgcggacgcgtcatcgagtgtgacgtggtgaaaggttatacaagtccacgactatccggaatcgggctttcctgctgggtgctctgaggcaggctgtatgactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggc

SEQ ID NO: 177639 - DNA, 4244 bp, Homo sapiens
  Payload ID: 14860
  Gene Symbol: RBM15
  Gene Name: RNA binding motif protein 15
  Uniprot ID: Q96T37
  ENST ID: ENST00000369784
  CDS Start-End: 901-3834
gcgcgcggggggcggggctccccccggctgttcactcagctaccacagcgacgtaaaatggtgtccgctaggcgtcccaggacggcttcctgagggactggagggccccgacagccggaaagcctgccccgccccttggccggcacaggtacgacggcggggagctcagaagtttcgaactccaagggccgaagcacagccaaacaccccacggaacttaacaaatgtttgtggggagaacgccgaaaacgcggggaggcggggctggcgcacagtcaccctctcgcgacatctaagtgacgtcgcacagcaagcacgtgttctagtctttcaccttcagtcagcctcctccgttatacaggcctacccctttaagcgagtgatggacagttatttcagcctatcaacttccttgccgacatccaatcagatttaaacttcttttagccgccggaggagttggaaaaagggggtcgaaagagggagcttaccgtctctcgcgatatcgctgtgagcctgcctctctggaaaaaacgccgaaactgatggcccgacctcccaaatagtggtttaaaggacgggtttataagccaatgaaagggataaggaggtgggttgctgctgtcactgagcaagaagtaccgttacagggcagactttttgtccaatcaacacctcaacactttgggtcacgtgaccgcagagtgcgaggggcggagctacagtctggcgcgaggaaccgttaagatagacaacaaatgtaaccaatgaggtactccgactagggggttgggaacccaataacagtggttgggcgggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgaatcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaa

SEQ ID NO: 177640 - DNA, 3316 bp, Homo sapiens
  Payload ID: 14860
  Gene Symbol: RBM15
  Gene Name: RNA binding motif protein 15
  Uniprot ID: Q96T37
  ENST ID: ENST00000487146
  CDS Start-End: 84-2993
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgaatcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaa

SEQ ID NO: 177641 - DNA, 3368 bp, Homo sapiens
  Payload ID: 14860
  Gene Symbol: RBM15
  Gene Name: RNA binding motif protein 15
  Uniprot ID: Q96T37
  ENST ID: ENST00000602849
  CDS Start-End: 84-2957
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgaatcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtggtgcgtcctaaagtccatgtgtaacttgtatttactactttgacatggttcctgttttgtgatgtgtaatgggatacagcatcagatgcaattttctttttagttgttagttgtagcattttcttttttatatttttataaacgtctttaaaatagaaatcaggacagtttagctatttttttgtttgtttagctattattttaagtgaaagggatgccctaaaggtagcaggcaggcagacagatttgctttaattaggagttcccacccttatgagtaattttttttctctattcagttgttttttttttaatcttgagcttaaaaaatcctcagagttacaaaaccaaaattttgaaaagtcagaatttggagaaaggagtccactgaccatataaagagagtaatagccacctaaaaa

SEQ ID NO: 177642 - DNA, 3284 bp, Homo sapiens
  Payload ID: 14860
  Gene Symbol: RBM15
  Gene Name: RNA binding motif protein 15
  ENST ID: ENST00000617047
  CDS Start-End: 73-2874
ccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgaatcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaa

SEQ ID NO: 177643 - DNA, 3431 bp, Homo sapiens
  Payload ID: 14860
  Gene Symbol: RBM15
  Gene Name: RNA binding motif protein 15
  Uniprot ID: Q96T37
  ENST ID: ENST00000618772
  CDS Start-End: 84-3017
ggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgaatcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaatgtt

SEQ ID NO: 177644 - DNA, 6641 bp, Homo sapiens
  Payload ID: 14861
  Gene Symbol: RBM15B
  Gene Name: RNA binding motif protein 15B
  Uniprot ID: Q8NDT2
  ENST ID: ENST00000563281
  CDS Start-End: 133-2805
gccccgccgccaccgccgcgccgagtccttttgtccaagatggcggcgccgggggcgctgcctcctcggccgccgcctccgccgccgccgctgtgagaaacctacgggccgcccgcccgccgcgccagcgccatgaagcggcagagcgagcgagactctagcccgagcgggcgcggctcgtcatcgtccgccaagcgtccgcgggagcgcgaacgggaggcggaggcgggcgggcggcgggcggcgcacaaggcctctggcggcgccaagcacccggttccagcgcgggcccgcgacaaaccccgcggcagcggaagcggcgggggcgggcatcgcgacggccgcggcaccggggacgcgaatcaccgcgcgagtagcgggcgctcctcgggctccggcgctggcggcgggggacgcggcggcaaggcctcgggggacccgggcgcctccggcatgtcgccccgcgcgtctcctctgccgccgcctccgccaccgcctggggccgagcccgcgtgtcccggctcatccgcggccgcgcctgagtacaagacgttgctcatcagcagcttgagccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgtgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaagaaaaa

SEQ ID NO: 177645 - DNA, 2755 bp, Homo sapiens
  Payload ID: 14862
  Gene Symbol: RBM17
  Gene Name: RNA binding motif protein 17
  Uniprot ID: Q96I25
  ENST ID: ENST00000379888
  CDS Start-End: 226-1431
caggcgcaggcgcaggcggggcgcaggcgcgggcgcgctctcccggcagcccgcgctccctgaccccgcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaa

SEQ ID NO: 177646 - DNA, 3751 bp, Homo sapiens
  Payload ID: 14862
  Gene Symbol: RBM17
  Gene Name: RNA binding motif protein 17
  Uniprot ID: Q96I25
  ENST ID: ENST00000446108
  CDS Start-End: 645-1850
agtccccgcggcgggcgctggtctctccacgcggctgcggcccggtaccctccgcccgccgccgcctctggtgaccctggccctgaccttctccctcttcccttcctcctcctcctcctcatgtctgcctcgggctgtttggtgctgaagagcgtttcttctccgtctcgtgcaccgcatcctgacgaaattgtctggtcaccagaaccgagtagcccgtagcgtgtcccccctggccctgcacggttgcccctctctggggctcggagccggttcctcccggggtctcagaactgggagtgcagacgttggcgtttctcagactccggagctgcccgggacaggaatgcagccctaaccccggcgtcgcctcggctcgtgcagtttgagcggtgtttcagcgctcacgtccgaccccaggcagtctttgagcttcgcctcttgccccgagaatgtgtaatgatcggagaatgcaggtggaatgaggttctgcccctgcttgcaggagtttggtttctgggaaagcaggcgtgaaaacccaggcccgggttgatttgagaaacgcaagtggggtctggaaggacctctcttgagagaggaggtcatgcttatgttgagtcttgaagcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaagatgcatccaagaagtcagattcaaatccgctgactgaaatacttaagtgtcctactaaagtggtcttactaaggaacatggttggtgcgggagaggtggatgaagacttggaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcactaaaaaaaaaaaaaaaaaaaaaactagaaagttttgggacatggggttatattaaattattctttgtttttctttttcttttaataaagcctgcaagttactaaattgtagtttcataaattctgtagtaaagtatcatcttggcagtgtgccaaaggtgaaaatgatgctttctctaacagagaaattcttagtgactccagtcgtagaaaaacgtctttacaacctgaataagattgaagaattgtgaacataccatggcctattggatgaatcatttgccgtaggctaaatcagactgtagggtttgtgatggatttatggagtatgtgggtatagaaatcatgaatctagcatttgttttcagagattcaagcatagtcttaagggtagatcagaaatgacaaatgaattcaaaacctagcaggtgcattgtaaatgtgtgcccagttatgttttggaaatggcagttccttggggtcatgtttctactggcaaaatttgcaatagtgttctattgtatgtaattttaaaatttataagattatccacgttggccaagtaaactgtactgccaatagaattctggaattgtgagaaattgtatcattgaagttcagtaggatgtgtggcttaaaaatttatcaggaccacaaaaaagaaaacaaaaatatttggtactgaggttcattgccagggcaggaggtatttccagaaaatactcatgcctgtgttctgttccttgctttcccaaatactgcatgtgactttcctaagcggcagctgaaagactcgagcccgtgctgtctcctttggttattatgacatgaaagtgtatcaagaactcagcatttctttgcatccatggacttggtttggagacataaggaatattctgaccctttttaaaaaaggattttctcatgtttttatttaacataaataaaagaataacattttatcttttgtggtattattttattgaataaaattgagttttatgataaaagtgcacctgttctgtaaagtaagttggggttaaggaatgtgaggtaaattacataattgaacattgtggaagacagaatcaaaagcagccctggaacttcagttatctatggaattaggcataccattcctcaagtggaaaccatgtttgtgcttacaagtaccggagtgtgcttgtttaattttagaaactaatggttccaacccacctttcatgcatgcatttattgttgttatgctttgtaaaacattgtttgcacctaaatgggtggcttttcctaacattctcatggtcagcaaccagagagttgcaaccaactcatactacttgatttccgttcgcatgaggacagcttggtgtgtgcctttctccccagtcttttatttttaaaataactgtgttaatcagttagtgctttatttataatgaatttctgatagtcgaataatttctaaatctcctgcaagttagtacttgagaaatttgaaattaattttcaatattaacatttaagctaatataaaaattttaaatttcaataaaaattaaaaattatgtaagctacaatgtaactggc

SEQ ID NO: 177647 - DNA, 833 bp, Homo sapiens
  Payload ID: 14862
  Gene Symbol: RBM17
  Gene Name: RNA binding motif protein 17
  ENST ID: ENST00000437845
  CDS Start-End: 114-833
gcgccgccgagcgccctgaggactcagcgaagggtgggcgccgccgaggcctcctgccgctggcgggtttccgcggagtgccgcccggctccgctctgccgccggcgcggctcatgggcagagtcggccgggcgggccggagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaag

SEQ ID NO: 177648 - DNA, 792 bp, Homo sapiens
  Payload ID: 14862
  Gene Symbol: RBM17
  Gene Name: RNA binding motif protein 17
  ENST ID: ENST00000418631
  CDS Start-End: 157-792
aatggtaccaggagcctgggcctctgttgctgaaaggtcctggaccttttacctctaaaatttcatgatacttattttaacatgaaaagcctttattgaattgtgcattctttaatccccaccccttttgcctttcagcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctccccca

SEQ ID NO: 177649 - DNA, 676 bp, Homo sapiens
  Payload ID: 14862
  Gene Symbol: RBM17
  Gene Name: RNA binding motif protein 17
  ENST ID: ENST00000447032
  CDS Start-End: 1-676
ttcccttagctgacgaatatgaccctatgtttcctaatgattatgagaaagtagtgaagcgccaaagagaggaacgacagagacagcgggagctggaaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaaggtgtgtccccagggaagcgtgtgactagagggaaaggactggccccatccatatcagacatggccagtcttgatcctcatgtgtcagcagggggacaatg

SEQ ID NO: 177650 - DNA, 805 bp, Homo sapiens
  Payload ID: 14862
  Gene Symbol: RBM17
  Gene Name: RNA binding motif protein 17
  ENST ID: ENST00000432931
  CDS Start-End: 142-805
gaggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgccaaagagaggaacgacagagacagcgggagctggaaagacaaaaggaaatagaagaaagggaaaagcgtaaagacagacatgaagcaagtgggtttgcaaggagaccagatccagattctgatgaagatgaagattatgagcgagagaggaggaaaagaagtatgggcggagctgccattgccccacccacttctctggtagagaaagacaaagagttaccccgagattttccttatgaagaggactcaagacctcgatcacagtcttccaaagcagccattcctcccccagtgtacgaggaacaagacagaccgagatctc

SEQ ID NO: 177651 - DNA, 4974 bp, Homo sapiens
  Payload ID: 14863
  Gene Symbol: RBM18
  Gene Name: RNA binding motif protein 18
  Uniprot ID: Q96H35
  ENST ID: ENST00000417201
  CDS Start-End: 142-714
taacgcgtcacgggcggcctggcagctggcggcattgaggcggacgcgtctagaggtccgtctgaccgcggcgtcgggacctggtttccgggcatgagctgagagcaccacgccgaggccacgagtatttcatagacattgatggaagcagaaaccaaaactcttcccctggagaatgcatccatcctttcagagggctctctgcaggaaggacaccgattatggattggcaacctggaccccaaaattaccgaataccacctcctcaagctcctccagaagtttggcaaggtaaagcagtttgacttcctcttccacaagtcaggtgctttggagggacagcctcgaggctactgttttgttaactttgaaactaagcaggaagcagagcaagccatccagtgtctcaatggcaagttggccctgtccaagaagctggtggtgcgatgggcacatgctcaagtaaagagatatgatcataacaagaatgataagattcttccaatcagtctcgagccatcctcaagcactgagcctactcagtctaacctaagtgtcactgcaaagataaaagccattgaagcaaaactgaaaatgatggcggaaaatcctgatgcagagtatccagcagcgcctgtttattcctactttaagccaccagataaaaaaaggactactccatattctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttctacgctcgtgtgtcttttacaacataaagaaaaagtaaaaggcagggagggaagtgagagacagattttaaatcatgttcagaactgttgttccagaatttactacggcaatccctccaactggactgaaaaagagaaagttcttggcaaaaaggagctgattctttgaacaaatgttgtagtaatctgtttaagaattatgcttattgtttcaaaatcccaactaggaaaacatggtgtatatcttaaaattgtttgtgttgacaaaactagaatcaaatttaacattttataccacaacacaagttctatttggaaattgaacttttattctatagcaaccatttttttcaaatctaaataaccatgccttctataataacaaatgttgctattatcatgggacttttaaaattacatttattgcatgggattgtttttatagcatgagaatgttctgtttggaattatatcatggtcagtctaaatagaaaaagcaaaatttctttgaaaacctaaacattgctatattggtcactatcaaacatacaattttctaataattgtgtagcggtctaagtggaagagattgcattatcttgtgcaggacgaggagaggacatgcagtgggcacagaaagtcaatggaacagatgccactgtggcaccaagactgtaatgactctgtgtggtaggtagttttaaaggactgcatgccttggaaatgattcttcacttggagaacatacttgcctctagatatgtttgtcactctaagcatcctgaatataacaatagagaaagataagtcaaccaacagatttagggatgtgtttcttcagcacattttggtcattttgatgccaagtttgacatactgtttaattgggcagcacctttgctcctttaccaggtatgtatcactttgttactccaggtgccattcttggtgatgacagaatgtttatcactatcgttgttagcaagaggaagctttcaatataggaacttaacatcttcccatgagtataaatgaatttaagacatttgaatcaaaacttcagtagagggaggttttagaattcataaaactggtttaaggaaattctttttacttttcccaaggttaatctttttaaatatctctagacatcaaatactttctgtatgtattagctgtgtctgtctatgatgcaagtaactctcctcctatttgggggatagttcagagaggtaggagcattatctcccatttttctggtgacttcttggagtatagaattcaccattttatccgtaagtcttcaaaggattatggtggactagaacttacatagtgcaaaatagtcttctatttttaataggaacttagaaaaaacttagaattatatatagagttgtttcctttagaaaccagagctatttatttgtatttaaagcactgtttattatttgtactgattcttatccctctgtgtgaataaatgtaagacggtgtccgtgtggttatatcttctctcgttcacttactggcatagactgcagttctctgacaggcttgtttccactcaggactctggccagcatgtccacgtggggtgcttcttctaagtgccttctctgcagagggttctggctagagagtcaaactgagaggcaactctctttaccctttatgcctgcctacctctgttgttagagatgagaatagagaccagctgtttccattgcaaatgtcactatttgaaaagaagttgttaatggaaatctctgcaagtatcgtactgtgtttagtctctcgtggtagagatttcaaaagaagaaatgtatgtatcctaaatatgctgaaagcagtctgatgaaaggtttttaaatttcaggtgttaacttggtcaactctttgttaggaggttgtctgtactttaagtaaaattattctttggtttactggttattttggtttgctaaaattatgtcacttataattttgatttatatacaagagtgaagaattgaaggaaatactgaggagagacgtatgaactattttcttcatctcaattcctattttatcaaatgcaaaatgtaatcctaaccagttgattttctataattggtatcttagtactggggaggagtatcacatgaggaaagatttttcaaagcatgtcagctgaggcacaagaatcgcttgaacccaggaggtagaggttccagtgagccgagattgtgccactgcactccagcctgggcaacagagtgagacaccgtctcaaaaaaaacaaaaacaaaacaggtcaaaaatcagttgcacaagttgtatgaaaccaggtattctgcagctctgtctcttgtttattaagatatgcacagtttctgaatcaacaaatatatctgtgattcttttatactactacataaaagaacaggagtaattcttgccttataaattaaatgtcaaacatttcctatatgtaatcatttgttcctaaaatatgatttagtcccagcatgcttatccctgttttctctttttctctccagctcctatctagttcttcaacaaatcctgtcaactctaccttccaaatgcctcttgaatccagccatctcaccacctccaacactaccaccatttttcttaaagccaccatcatctcttccctggactattacaataccttcctaattatctccctgcctctgctattgattctttagggtccgttttccacacagtagccaaagcaatttttaaaaaaattattttaaaatgtgattctcttctttgtggctttccatcacagcctagaaaaaattgaaagatctgtaaggccctaatgacctgtccttcactacgtgtctgaccctatagcctactgttctccccttgtgcggtgtactgcagccacgttggccttcttgctattctttgaatacaagggagcttctacttcaaggcatttacattggctgttgccttagcttagaacgctctttctccagatagccgcagagcccgctctctcacctgactcatgtctctgctcaaatgttaatgatcaagaggcagtccccggcctccctcttaaaattacaacctgtcactctccaatcctttcctcacgattttctcaaaagcacttaccgctaaccaacattatatctaaatttttttttgtctctttttattggaatgtaagtttcatgtaagcaggaactgtatatcactgctataccctcagcatttaaaacaatggctgtacatcatacatactcaataaatatttgttggataaactacaagaattctggtatttgagagccaaagggccttaagagaccatctcatatagccccctcattgtccagatggggaaaacgggaacccagagagacaaagcgatttggccagggtcacctggttaatgggagagctttaggtagaacccaggcctgcaaacatctagtccagtgttcagcaaactggcctctgcctcctaattttgtatagcctacaagttaagaatgatttttttttcattttcgagtggttgagaaaaaaagtaaacaaaatatatatactatattgtgacatgaaaatgatacgaaattcaaatctcagtgtatgttaataactattagaacacaaccatgcccaggcatttacatgtggctgttttccccatataatagaagagttgaatagttggcaatgaagactgtggcctacaaaacctgaaatatatactatcggtccctttacaggaaaaatttgccaaaccctactctaaacaatattccatgactggaaatgtgttttctaaaattctcgtattaatgcagagaataaaagcaacagatgtcagaatgatgtgcaccg

SEQ ID NO: 177652 - DNA, 4194 bp, Homo sapiens
  Payload ID: 14864
  Gene Symbol: RBM19
  Gene Name: RNA binding motif protein 19
  Uniprot ID: Q9Y4C8
  ENST ID: ENST00000261741
  CDS Start-End: 145-3027
cttccggacaggtcaggccaaggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggcccagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaaggtcggaggagacaggggatgaggaaggcctcaggccactgcccagcggcccaggcatcctgggtttcaccagtgacgcgttctagcagacactgactgcgcacctgctctgtagcagacacggaagagtccaagggagcagccacgttaggaagagagacttgggaacagctacacagggagctagaacccctgctccccctgtccccaccccaggagagtaaggggacgagggccagctctctggcatcaggctgcttggacatgaaaccccgtctccaagctcaagctgggagaccctggcccagtttccttatctccttgggcccagccttccccttgctagctagttcttacttcataaggttttagagagaaataaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatca

SEQ ID NO: 177653 - DNA, 3574 bp, Homo sapiens
  Payload ID: 14864
  Gene Symbol: RBM19
  Gene Name: RNA binding motif protein 19
  Uniprot ID: Q9Y4C8
  ENST ID: ENST00000392561
  CDS Start-End: 84-2966
gcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggcccagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagaggggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatcagca

SEQ ID NO: 177654 - DNA, 4422 bp, Homo sapiens
  Payload ID: 14864
  Gene Symbol: RBM19
  Gene Name: RNA binding motif protein 19
  Uniprot ID: Q9Y4C8
  ENST ID: ENST00000545145
  CDS Start-End: 80-2962
cgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggcccagctgcaggagaccttcggccattttggcagcctgggccgcgtgctgctgccagagggcggaatcactgccatcgtggagttcctggagcccctggaggcccgcaaggccttcaggcatctggcctattccaagttccatcatgtccccctctatctggagtgggctccagttggcgtcttctccagcacagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggctggagtgcagtggcgtgatctgggctcacctccctggttcaagcgattgtcccgcctcagcctcccaaggctgggattacaggtatgcaccaccacgcccggctaattttgtatttttcatagagactgggtttcaccatgtagaccaggctggtctcgaattcctgacctcaagtgatccacctacctcggcctcccaaagtgtggggattacgggtgtgagccaccacgcccggctaattttttgtatttttagtagacagggtttcaccatgtgggccaggctggtcttgaactcccaacctcaagtgatccacccaccttgttctcccaaagtgctgagattacaggtgtgagccaccatgcccagcctgttcctaaccctttcaactggggggtctcaagtgggtgaggactccatggccacggcagcagaactgtctcttctgaaaaccagactccggggcccctgggtcagcacctctaggtcattccacagacttacacagtttaaagaaagagccagcgaacatggggtgatcctggggtgccactgggatcccaagccaggcccggaggtctgcctgtttcgtccccagaaacttgagctggcatcctccgctggtttgcactgggcacggggactggagagccaccaggccactgagcgcagcatgctatcacttctcaggaagttgtgagggtgaggagaatagccgggcccactctgcagaggggaggaacaggcacaggctagaggcacgggctgatagagtgagtcctctccctcattcattcattcattcattcattcatccatcagacacctgctgggcatctgctgtgtgcgagacactgtgctgggtgccccagacacaagacagaaactcgggtcgctctgtgtgcctccacactggccttccctgctgcgtggacgcaggctctgtctcctaggctttaagccccatgcatcaggtggaagacaatttccagcagcctctgcccgcttgtttttcctcctctccttttcctgccgccttggtcttttttgtcttttgtgcagggccgtctctcgcagcgcccgtctgtgctccgcagcgtctaggaaaggattagtgtgagcagagcacgcaggctttggtgaacagagccgagcttggtttcaacatctaattcaatttgttctgccgagattgaaatatgaaatggttgccagtcaaacgttcaaaggacggggaagggagagtgagcgcatgctgaaatttaaattttaatgaaaatgactttaaccctttggtacaccttgcaaaatgtaacccatcctcccatcctgtgaaagcggcctctcgggttagagcttttccacccacttctcttccactgagcttcactaataatatgtaatcatttttttcagccgtcttaataataaaagattaatag

SEQ ID NO: 177655 - DNA, 588 bp, Homo sapiens
  Payload ID: 14864
  Gene Symbol: RBM19
  Gene Name: RNA binding motif protein 19
  ENST ID: ENST00000552384
  CDS Start-End: 1-333
gtttctagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaagctcaagctgggagaccctggcccagtttccttatctccttgggcccagccttccccttgctagctagttcttacttcataaggttttagagagaaataaacgcagtaatgcatgaagagtg

SEQ ID NO: 177656 - DNA, 7233 bp, Homo sapiens
  Payload ID: 14865
  Gene Symbol: RBM20
  Gene Name: RNA binding motif protein 20
  Uniprot ID: Q5T481
  ENST ID: ENST00000369519
  CDS Start-End: 59-3742
ccgggaccgcccctcccttgagctctctcgccgcgatcccgggcgggtctcgccccgcatggtgctggcagcagccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagatcatccaaaatgccgccaagctcctggacaagaacccattctcggtcagtaacccgaaccctctgcttccttcacctgccagtctccagctggctcaactgcaggcccagctcaccctccaccggctgaagctggcacagacagctgtcaccaacaacactgcagccgccacagtcctgaaccaagtcctctccaaagtggccatgtcccagcctctcttcaatcaactgaggcatccgtctgtgatcactggcccccacggccatgctggggttccccaacatgctgcagccatacccagtacccggtttccctctaatgcaattgccttttcaccccccagccagacacgaggccccggaccctccatgaaccttcccaaccagccacccagtgccatggtgatgcatcctttcactggggtaatgcctcagacccctggccagccagcagtcatcttgggcattggcaagactgggcctgctccagctacagcaggattctatgagtatggcaaagccagctctggccagacatatggccctgaaacagatggtcagcctggcttcctgccatcctcggcctcaacctcgggcagtgtgacctatgaagggcactacagccacacagggcaggatggtcaagctgccttttccaaagatttttacggacccaactcccaaggttcacatgtggccagcggatttccagctgagcaggctgggggcctgaaaagtgaggtcgggccactgctgcagggcacaaacagccaatgggagagcccccatggattctcgggccaaagcaagcctgatctcacagcaggtcccatgtggcctccaccccacaaccagccctatgagctgtacgaccccgaggaaccaacctcagacaggacacctccttccttcgggggtcggcttaacaacagcaaacagggttttatcggtgctgggcggagggccaaggaggaccaggcgttgctatctgtgcggcccctgcaggctcatgagctgaacgactttcacggtgtggcccccctccacttgccgcatatctgtagcatctgtgacaagaaggtgtttgatttgaaggactgggagctgcatgtgaaagggaagctgcacgctcagaaatgcctggtcttctctgaaaatgctggcatccggtgtatacttggttcggcagagggaacattgtgtgcttctcccaacagcacagctgtttataaccctgctgggaatgaagattatgcctcaaatcttggaacatcatacgtgcccattccagcaaggtcattcactcagtcaagccccacatttcctttggcttctgtggggacaacttttgcacagcggaaaggggctggccgtgtggtgcacatctgcaatctccctgaaggaagctgcactgagaatgacgtcattaacctggggctgccctttggaaaggtcactaattacatcctcatgaagtcgactaatcaggcctttttagagatggcttacacagaagctgcacaggccatggtccagtattatcaagaaaaatctgctgtgatcaatggtgagaagttgctcattcggatgtccaagagatacaaggaattgcagctcaagaaacccgggaaggccgtggctgccatcatccaggacatccattcccagagggagagggacatgttccgggaagcagacagatatggcccagaaaggccgcggtctcgtagtccggtgagccggtcactctccccgaggtcccacactcccagcttcacctcctgcagctcttcccacagccctccgggcccctcccgggctgactggggcaatggccgggactcctgggagcactctccctatgccaggagggaggaagagcgagacccggctccctggagggacaacggagatgacaagagggacaggatggacccctgggcacatgatcgcaaacaccacccccggcaactggacaaggctgagttggacgagcgaccagaaggagggaggccccaccgggagaagtacccgagatctgggtctcccaacctgccccactctgtgtccagctacaaaagccgtgaagacggctactaccggaaagagcccaaagccaagtcggacaagtatctgaagcagcagcaggatgcccccgggaggtccaggaggaaagacgaggccaggctgcgggaaagcagacacccccatccggatgactcaggcaaggaagatgggctggggccaaaggtcactagggcccctgagggcgccaaggccaagcagaatgagaaaaataaaaccaagagaactgatagagaccaagaaggagctgatgatagaaaagaaaacacaatggcagagaatgaggctggaaaagaggaacaggagggcatggaagaaagccctcaatcagtgggcagacaggagaaagaagcagagttctctgatccggaaaacacaaggacaaagaaggaacaagattgggagagtgaaagtgaggcagagggggagagctggtatcccactaacatggaggagctggtgacagtggacgaggttggggaagaagaagattttatcgtggaaccagacatcccagagctggaagaaattgtgcccattgaccagaaagacaaaatttgcccagaaacatgtctgtgtgtgacaaccaccttagacttagacctggcccaggatttccccaaggaaggagtcaaggccgtagggaatggggctgcagaaatcagcctcaagtcacccagagaactgccctctgcttccacaagctgtcccagtgacatggacgtggaaatgcctggcctaaatctggatgctgagcggaagccagctgaaagtgagacaggcctctccctggaggattcagattgctacgagaaggaggcaaagggagtggagagctcagatgttcatccagcccctacagtccagcaaatgtcttcccctaagccagcagaggagagggcccggcagccaagcccatttgtggatgattgcaagaccagggggacccccgaagatggggcttgtgaaggcagccccctggaggagaaagccagcccccccatcgaaactgacctccaaaaccaagcttgccaagaagtgttgaccccggaaaactccaggtacgtggaaatgaaatctctggaggtgaggtcaccagagtacactgaagtggaactgaaacagcccctttctttgccctcttgggaaccagaggatgtgttcagtgaacttagcattcctctaggggtggagttcgtggttcccaggactggcttttattgcaagctgtgtgggctgttctacacgagcgaggagacagcaaagatgagccactgccgcagcgctgtccactacaggaacttacagaaatatttgtcccagctggccgaggagggcctcaaggagaccgagggggcagatagcccgaggccagaggacagcggaatcgtgccacgcttcgaaaggaaaaagctctgatgcttctgcttctgctgctactgctgctgctgcaaggttggaaaggagagcttgctgaagtggggccttcctgattctggggacaggactaaagcctgagaggaaggaaaaccaagcagggcacattgcttgggcttgttcccagagactcagtgaaatgcccctgatatgtctccaggagcaagtcacccaggtgtgtccagcccactgagggtcaccaactctctccctgctgactcttgtttctctcaatctttcaattcgtttttctctcttttcctcttgttctttctctccctccctccttatgtgccaaggatcgtttccttttcacaaaacccaacttctcagggattttcacagtgtttaaattcttggtaggatataacaggtcaggcctagctgagtcaggcaaggaaaaggtttaatggaaactcctgggtcaggcgaacccctgcagtgagtctacagcagtatctctgcctggtgtcccatgtatcccctgcatgaggagctgagtcaggtctgcagtcctggtgaggggacatcacggacaatctgttggcagagctgggagggtcttcattaacctcttcctccaactgggccacccttttgaaaagcccctgtttttaataactgtttcatcctctcagttattctagaaatctgccagacttatgccttaaagtaaaattaaatgaattttagagaagatgaaaagagcccttcattttggaagctctgataagtttcctccaaacttattcccctcctcttgatttcaggagatgtcagggtttttctattctggacaatgaatttggtacagagtcactgtaattaaatataaaaacagaagcatcttcctccagctaaagcagcagttggcgcgggcttaggttgaatgctggcctctctgcaaagcacagctttggctcgagaggcacagctccaggctgtggaaaacagagttgtcttgggggttaaatgagcttatttaagtcaaggaaacatcatctgtccttgattcagccttggtgcctgcactctggggtacaaccacctcacagtaggatggtttttaaatggccccccagttgggggagaagctaaggaaagagaaggctgcagatccaaagagtggcattgaagtttgctgggtgtctgtaggtggaccctttccagctgggcagatagttgagggctccctgggtttgactgtatgtgcagactttgataccaaaatgttatgaaaagtcgtgattcccgctgctctttctggtactggagggtgggtaccttcaggctgtggggtctctagcctgatattccattgaaagggtgtgggataaaggtgctgggggaaatgaggctctgccacagccatagagaggccctcgggcagttaagaagggagcctggagctgttttcatgagcagagatactctcctgaaagcacccttcatagcttagcccaggaaaaataaaacaaggaagacaggtcactctcccctaggcagttcctgttgtttctgttcctgaccttgggcaggcagactgagaagggactgtgtagggttttgttttgttttttttcattttcctttttatggcatgtgagagcatactgtacattctgtcctctgtactaatggaggaagggcagagagattagttcaaggctaacattttatatcaggtaactgaggcacacaaagggaacaaatgaagaacataaaatgatcagtgtaaacctgaaagcacgcagtcattggcaagggacaggctcatgggagctggtgagagagagcagttaaggcaagcaccaggggaaagcagaccaacttgaacagatgtgatgcggagaggttggaagaagcaagaaacctgaactcatcatcaggctattaaataaaatttataggaggctgttggtttggactgagctcctgcaataggcccaacagaccaaaacaaaagggagtcactcatgttgaagttctgtcttccaggaaatcaggagagagagagagagaaagaatagccaaatccccaaacaggccagttttaaccagcatgatgaagtgtccttggttttaacctttataaggaaagcagctttgagatgaccagtctggtttttgttctttgtgtctgctttcctcagcccttttctgtctataaagccaacctcctccgctcagctcatgggaacactcattctattttatagaatgacatgttgcccaattctagaatcaaaaataaaggccaactaagatcttcaaagtaaatttgttgtaattttatcttttgagaagaccatatgggggctgctgaaaagttggtatctcaaataaagtctgaagatcacggctcagcccagattgttcccctggccaactccacaggtttgaacctggcattctggacaccagctatgcctcctccatttctcagaaaacctttgatcttgtgtgtctttcttcctactgaagggaattgtgggggcagttctttggccttcttgctgaactttgctggaaatagcccacaatttttatcagaggttagaactgtacattatcagagagactggacactttatcccctagcaaagtgggagaagattttaccagctcattccactccaccctggccttcccccaccccccatccccagcagcatttccatggaaatccagatggtcgtgtagtgttatggctctcttgtgatagactggccttcatattggagagctagggagagcccctgggagggagagagataaggcgctatctgccttcaatcagaaccttcggtttaaaatcatctaagagtctatacttgtgtgtacatacgtatttatttttatttatttttatacaattccattggcatggtccttcaccgaccctatgatttgcactttttatttctatgtgtgccacacacaatgcagtattaatggcaaccaggtaaatattgatttattttttaaagcttttcttcagtgttttgtcaaccatttcaaagtgtctcccaaaaaaggatgctgaagagcaattgctcccttaagcaacagattcatatttaccctgggttaatacaacaaaaggcctgtataattgtcttttcattgttaacacccaaaatagcatctatctagacagtatccccaaagaatttggaaaatctgatggtgtgagcagcagccgttagtatcagggtttcccattcttggacagtccgaggctgtgacctgttagataattagattatacttgaactggaccagagtttgttttttgaatttatgagaaaaaccaaaacactaagttaagtttgaacttgtaaagtattgaaatttgttgagtgtcctataaattgtcactacttttcctgatctgtataactgactgcaaagtgtttgtttttacaaaagagaaaagaaaagatttttaataaagagaatttgaaagctgt

SEQ ID NO: 177657 - DNA, 2342 bp, Homo sapiens
  Payload ID: 14866
  Gene Symbol: RBM22
  Gene Name: RNA binding motif protein 22
  Uniprot ID: Q9NW64
  ENST ID: ENST00000199814
  CDS Start-End: 123-1385
aagaagccctagacgcgtaaataagacgccgaccggcgcggcgctagcctcggggcttgacgggattgtggcggtcctctctcccaattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaattttt

SEQ ID NO: 177658 - DNA, 1386 bp, Homo sapiens
  Payload ID: 14866
  Gene Symbol: RBM22
  Gene Name: RNA binding motif protein 22
  Uniprot ID: Q9NW64
  ENST ID: ENST00000447771
  CDS Start-End: 39-1154
caattcggaagctacagctacctccggacgctctcaagatggcgacctctctgggttccaacacctacaacaggcagaactgggaggatgcggacttccccattctgtgccagacatgtcttggagaaaacccatatatccgaatgaccaaagaaaagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaagaaatcatttctaccagttcggagagatccggacgatcactgttgtgcagagacagcagtgtgctttcatccagtttgccacacggcaggctgcagaagtggctgctgagaagtcctttaataagttgattgtaaatggccgcagactgaatgtgaaatggggaagatcccaggcagccagaggaaaagaaaaagagaaagatggaactacagactctgggatcaaactagaacctgttccaggattgccaggagctcttcctcctcctcctgcagcagaagaagaagcctctgccaactacttcaacttgcccccaagtggtcctccagctgtggtgaacattgctctgccaccgccccctggcattgctccacccccacccccaggttttgggccacacatgttccacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataa

SEQ ID NO: 177659 - DNA, 566 bp, Homo sapiens
  Payload ID: 14866
  Gene Symbol: RBM22
  Gene Name: RNA binding motif protein 22
  ENST ID: ENST00000518917
  CDS Start-End: 30-566
agctacagctacctccggacgctctcaagatggcgacctctctgggttccaacacctacaacaggcagaactgggaggatgcgacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagagatttctaactctgatggaacacggccagttggcatgctggggaaagccacatctaccagtgacatgctgctcaaactggcccggaccacaccctactacaaaaggaatcgaccccacatttgctccttctgggtgaaaggagagtgtaagagaggagaggaatgtccatacagacatgagaagcct

SEQ ID NO: 177660 - DNA, 731 bp, Homo sapiens
  Payload ID: 14866
  Gene Symbol: RBM22
  Gene Name: RNA binding motif protein 22
  ENST ID: ENST00000521464
  CDS Start-End: 3-731
ggatggaaggaggaggcgaagccgcgcaccttgcaagctggcaggacagggcctgcggcgcggccgaaggaataccggggaggagccagcgcggcggcctagcttggccggagcaggagggcggagggcgatcctcctgcgggcttgaagggagggggcttagccagggtcccgggaccagcaccctttccatccctgccccctccagcctattagagctggttttcttttctcccgccgcctgccggaagtgcagacagcgccccctcccgcgatcgggtcgtgatggacttcgggttcctgccgtgcctagttccccaccctcgcttcccgccccctcgccaccccaagtgtcactgaggtgtcagggtcttcggagggtggtcctcaaccagatttcccattttcaccaggacttccccattctgtgccagacatgtcttggagaaaacccatatatccgaatgaccaaagaaaagtatgggaaggaatgcaaaatctgtgccaggccattcacagtgtttcgctggtgccctggagtccgcatgcgtttcaagaagactgaagtgtgccaaacctgcagtaaattgaagaatgtctgtcagacctgcctcttagacctagagtatggcctgcccatccaggttcgtgacgcaggattgtcttttaaagatgacatgccaaagtcagatgtcaacaaagagtactatacacagaatatggagagagag

SEQ ID NO: 177661 - DNA, 2361 bp, Homo sapiens
  Payload ID: 14867
  Gene Symbol: RBM23
  Gene Name: RNA binding motif protein 23
  Uniprot ID: Q86U06
  ENST ID: ENST00000346528
  CDS Start-End: 191-1408
gcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaac

SEQ ID NO: 177662 - DNA, 10040 bp, Homo sapiens
  Payload ID: 14867
  Gene Symbol: RBM23
  Gene Name: RNA binding motif protein 23
  Uniprot ID: Q86U06
  ENST ID: ENST00000359890
  CDS Start-End: 197-1516
gcatgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatcattgtgtttatttatttaaccacctttagaaagaaaaatgaaaactcacacctgggtggggttcccattctgtatctgcattacactgttgatctatggttgtcttctccatctatcttcatcctaactatctccatcccagctacccactggacagaattacccaaacagccaagttgcagcaccaggacagacttagacttaacaggctccttctctgtgcctaatgacagatctttccagcagatggcactatgacagtactgcattctacacttgtttttttctagtggggcggggcggggaggggggggggttgtgatcttgaagagttaagtaccagagctaagctgagctttcttaactctattggcctttgtacctgcctttgaccctctttgtagtagcgatcccaatccaatatccaaaggggtttgggtcttgtataacagcagggttctcctgacctgatgtctactgttgttcctctgtcagtcccctcaactcctgctttccatgtggctctgcctgggataacacaggcctgggaccagtgaattgtagggaactgagtattccagaaatacctctgtgaaagggaaggtgcacctaccactgccttaataataagggggtgggagagaggctgtctcacccagcttagggaccaaatgagaaggcctgaattcaggggcagggctctgtggggctccttttttgatctctatggcaacaaaatgctaagactttcttatgctaaaaatatggataattgctgttaggttttaatttgtcagctctcagacttctaagccagtgatgttagcctctggggttgcttttaacacaaaatcatttaaatacttgaagcctgcttgagtcataaaaggccagtgggactctagctcctaagtctgtttgctgcttctgtaacaatagcacagactaatttgtaaagaaaagaggtgtaggctgggtgcactggctcacgcctgtaatcccagcactttgggaggccgaggtgggtggatcacgaggtcagttcaagaccagcctggccaacatggtgaaactctgtctctactagaaatacaaaaagtagctgggcatggtggtgggtgcctgtaatcccagctactcaggaggctgagacaggagaatcgcttgagcctgggaggcggaggttgcagtgagccgaggatgcaccactgcactccagcctgggcaacagagcgagcctccatctcaaaaaaacagaaaagtgtatttctcacagttctggaggctgggaatttcaagagcatggtgcctgcatcaggtgggggtcatcccatgtcagaagggcacaaggtagaaatgagtacatgagacaaagggaccatgggccaaacttgctttataacagccctctctcatgataacctgctgtgtgatagtgacattaatccactcatgagggctctgtccttgtgactcagtcacctcgtattaagccccatcttcaacactgttgcattgggagtcaaatttccaatgtgaacttttgggggacacattcaaaccacagcatttctgattcttccaggcctagatctcacatgatgttgctgttctcctggttaccacccccatcccttcccccatcttatcctagtttgctttctggaccgggggaaaagggaaggaggatgcactatttttaggtagaagctgctggctatgacccagcacccctacagttattgatttggcttctaatgtatcttgagaagtgcagtgggtaccgtttttgttagtcatcctgaggccatgaactgggtcttctcatggctggcttggctccttcagactattataaatatccacaggccttgcctccctgccttcctctgcttggtttccttatgtttccatccctagctaccttggccttcctacactcggatccttccacctcagttctttcttgttcttagttcctcacatagcctcttgctgggagagagacaatgttggaagtaaggacgtatctaagacaatttccagtcttactccatataaggtgatggtatctagtgagtgacagttgctgtccgtgtgtgactcagtgccttcttgttactcatccctccatacgaggtggttagagtggagagaagcgggctgtgaacagactctgggcccagcttaaggtaaaagaaacttccctcaacatctacctgcacatggtggctggtggcgtaggggtgacattgtgatctagatcctttgccagcatagttagaatttccctaccagtcttcagttctagaaaagattctcacctgatttttgacttccagtctatgcttctgtattcactaaggtggcagcatttcctccctgttctttaaactgctgtgctcttgacacaggaattctgcctgcttcctcagactcccaacaacccccagataggagttaccagtagaagcagaggcttgacctgtgaacttttagtcctggagcatatcatgaagggaattgagtaaaaacctgaaggatggaattatatcacagtccctcttttccgtgtaatggaaaggctttagtgaaaatcaggcagcaacacttggacagtgaaaagagactctgaaaggtgaggtgacaggaggtggcataatggtcattgttaacatttatgcaaggttggttgtaggttaggtgttctaatcgtgtattaagtcacaaaatcctcacaacaatcctctcaagtagtttattatctttactttgtaaacaaggaaacatatccaaataagttaaataattttccccataagcacaaagttagcaagttagggattccaatccaagtactctcgcttcagatcccttgatcttaaccttacctgcctctcagcaccaccatggaagacaaggccttggagtcagtgaggaagtgtcacttttcctatccctgtacccatagctctccgtagactcagaatttttccactgccatgtctttgcttatcttgagtgacagtgtttgtgggtgaaccttgaaggtgctctttctgctacaagggccctgggagatagcatgggcatgtgcattgagaagccagcctcagaccttatcttgaagcagcttgaggccagacctactgtaggctcagcatcttgctaggaggcatgggagtgatctaacctgccagctatctctcttcctttcctccttctgctgatcaaagtcctgtcctttaagaccctgaagctttcctaggtggagttgatctctcttttcagtattctttgtcctcttgtgggtcatcttactctacttttatttagtaaataaaataattgcaataaaaattattttattgaaaactccattacttgatggttacagcctgatgaggccagacttggatgtctttctcatgattgctttgccttgcacatattaaatgtctgtagaattgaatgaatgctgttcattaaagtgttaaagtcagcaccaggctttccaaaggctgccccttctaggctgcttttcccagcagcctcatccattccttcctcactccaccaggagagaagatgcagctttactctttctgatgttaccatggtagcctgtgatactttctttctaaagtgctgcttgccatccaccagagactgatgtttccatggcaaccaggtgaaggcaatagtcacgagctggatgcaggaaaggaattccggtctgagaagctgcatatctgaatcttctagcttcagacatcctttcccctctctcataacttttgcgctttatatccaggactggtttgctctctggtgtgcccttggttgagagagctctgtgaaagtgaggtgaagcagaccaaccaacttagatcacgtgggaaggtgggtgcaaggaaagagctgagcaaagatcacttcaaaaagttggatgaagtctattagttgttcagatgatctgctctcaagagcccttaaggagttggctggagtttctggagagccattaagcagttatttttgagagcaatgggtagatggatgaggtgcctgaagactggaaagcagccagtcagtgccggattgtagaaaggagaaacaatgaccttggaaatcggagacccgtcaaacttgccaatgttccagaaaggatgggagtttcagtcagctttcaggcatcaggaagcctacttgcttagaattagtggtgctaagaattcgcctcctcaactcctgagcataagcaagctaggggacctccaccctgtagccgagtgtcacactctggaaccacacagcatggttcagatccctcttccctcacaaactagctgaataagcttgggtaggttacttcacttctctcacacttcatctgtaaaaaggaaatgataacacctatctcatagggatgttgtgagaattcattgagaaaggtttggaacttggctcattactgtcctcagtattttcactcctctggatgcctactcacttgattttctagctgacttcattctccccaactttagagctcaaggtttatggggaaaagcaagggcagtgcaatggtgaaaataaatcttcatttttaaataaataaattgttcctgcactgaagccccaagcttacaaggtcttgggtcacacacaacctgcctagttttcaggaaaacagatcccactagcccaatctctttatgcttgaggctctgtccacatagttagattttaaccagatggtttcgaaaaatcaaaatgagcccccctcacaggtaccttcaaggtacctaacaccattagctttgtctggcaggggaaaaataccagggcactcagttttgttttgttttgagacagggtctggctctgttgcccatgctggagtacagtggtgccatcacagctcactgcagtctcaacctcctgagctcaaatgatcctcttgattagctggaactacaggtatgtgccactatgcccagctaagttttgtattttttgtagagatggggtcttgctatgttgcccaggtggtcttgaactcctgggcttaagtgatcctccctccttagcctcccaaagtgctaggattataggtgtgagccaccacaactgcctgagagcaccctctgttaccaccctttccttagcgtctcagcctcccccaagcacctgtctttgttggtctccagagcctagccctacactggcattttcctttctgaataagtattttttttatttatttatttttattttttctttgagatggagtttcgcttttgttgcccaggctggagtgcaatggtgcgatctcggctcaccgcaacctctgcttcctgggttcaagtgattctcctgcctcagcctcctgagtagctgggattacaggcgtgcgccaccactcccagctaattttgtatttttagtggagacagggtttctccatgttggtcaggctggtctcgaactcctgacctcaggtgatccacccgccttggcctcccaaagtgctgggattacagtcctgagccactgcactgggccttatttatttatttttaattaattaattaattttttttgagatggagtcttgctttgtcgcccaggctggagtgcagtggcgcaatctcgggtcactgcaagctctgcctcccaggttcatgccattctcctgcctcagcctcccaagtagctgggactacaggcacctgccactatgcccggctaattttttgtattttttagtagagatggggtttcactgttttagccaggatggtttcgatctcctgacctagtgatccgctcgcctcggcctcccagagtgctgggattacaggcgtgagccactgcgcccggctgggccttatttatgtatttttctgagacagagtctcatgctatcacccaggctggagtgcagtggcatgatctctgctcactgcgatctctgctcacttcaacctctgcttcccgggttcaagtgattctcccacctcagcctcccgagtagctggaattacaggcacccaccaccatgcctggctaatttttgtaattttttttagtagaaatagggtttcaccatgttggccaggctggtctctctcttgacctcaagtgatccacccacctcggcctcccaaagtgctgggattacaggcgtgagccaattgcccgacctgagtaagtattttaaatcagcacaggtcctctgcttaaagtcaagttgtaatttgaacacaaaaatggaaaatcatgcagtaaaataccatcgtggagcttcaattgccaatctgtcccccaaccttccatcagatgacaaaacccaaaaaagtgttacccgtgagtcctatggaaggcacgttggactttgtagaccataacttaaatttttatctccaaatggtgctgtgctttgagagtttagcaagctgctttgatgcctaaataaagggccaggacataggttgcaaaaggcattactacttccaccgcttctctgtataatgcttgagaaattacaaagatctttgctcttttatttagtcctcatgacttcgctataaggtaggtattcttcattttagagttgggatagcatagctgagttcagcaaaccagacaggttaagagtgacttcatccacagacccccatccaggaaacatcctgagcactaattgaaaagcattcaagggcttactgaatttgcattcacatctggagttttcaaggccactaagctgtggaaacttgacatcaatattcaaatagatgaaaagggaccttaagcatatccatcagggagtcaccgagatgataaaggcctgagaagcagtatgctcttgtccggcatttgtgtcctttgacgactgcaccatccacccaaattttgctgccttctttataggaagggccttttcctcatgtggtgggctgcccactgtttcttctctgtgcatttgctcatgtagtttgaccacaaggaatgcttttccttctttctctcaactatctatagcctacatatcctttaaggcccagtttctaaaatatgtcttccaaatttactgtttcttccattcagaattcctggagcacatgaggtagcccccagttagatagaatgtggtattgtttgctgctattttgcctgttttgtgctgtatcacctcatccatctccccagcttaattgcaagctatttgacgggcagaaattgtgtcttatttgtatttgttttccccattgggcccggcacactgattggcatattgcagatgtttagtacttgagagaaacaaaatgtcttctagcatttgtggatgaaagattaaaatgtccaggaaaatttacttagattgatgtggattgaaactatattagattaataaaaagatgtgtgtgtgtg

SEQ ID NO: 177663 - DNA, 2430 bp, Homo sapiens
  Payload ID: 14867
  Gene Symbol: RBM23
  Gene Name: RNA binding motif protein 23
  Uniprot ID: Q86U06
  ENST ID: ENST00000399922
  CDS Start-End: 195-1466
atgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaa

SEQ ID NO: 177664 - DNA, 1743 bp, Homo sapiens
  Payload ID: 14867
  Gene Symbol: RBM23
  Gene Name: RNA binding motif protein 23
  ENST ID: ENST00000542016
  CDS Start-End: 540-1349
gcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagt

SEQ ID NO: 177665 - DNA, 552 bp, Homo sapiens
  Payload ID: 14867
  Gene Symbol: RBM23
  Gene Name: RNA binding motif protein 23
  ENST ID: ENST00000557227
  CDS Start-End: 490-552
atgcgcagattggggaaggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaag

SEQ ID NO: 177666 - DNA, 602 bp, Homo sapiens
  Payload ID: 14867
  Gene Symbol: RBM23
  Gene Name: RNA binding motif protein 23
  ENST ID: ENST00000555722
  CDS Start-End: 451-602
ggttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggttataggtatggacacagtaagagtcctcatttcagagagaagagcccagtcagggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgcc

SEQ ID NO: 177667 - DNA, 582 bp, Homo sapiens
  Payload ID: 14867
  Gene Symbol: RBM23
  Gene Name: RNA binding motif protein 23
  ENST ID: ENST00000557549
  CDS Start-End: 280-582
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgggtcacacattgctgcccaggctggagtacagtggcgtgatcttggctcactgcaacctccaccttttgggttcaagtgattctcctgcctcagcctcctgagtagctgggattacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggac

SEQ ID NO: 177668 - DNA, 267 bp, Homo sapiens
  Payload ID: 14867
  Gene Symbol: RBM23
  Gene Name: RNA binding motif protein 23
  ENST ID: ENST00000553876
  CDS Start-End: 89-267
gaaaaaactaccagcctgaaaatgcatagtgtttgctaccttattgcttttagcacatctagaaagacactaaacccaatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaa

SEQ ID NO: 177669 - DNA, 583 bp, Homo sapiens
  Payload ID: 14867
  Gene Symbol: RBM23
  Gene Name: RNA binding motif protein 23
  ENST ID: ENST00000555676
  CDS Start-End: 284-583
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatggaatcttgctctgtcacccaggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgg

SEQ ID NO: 177670 - DNA, 457 bp, Homo sapiens
  Payload ID: 14867
  Gene Symbol: RBM23
  Gene Name: RNA binding motif protein 23
  ENST ID: ENST00000557464
  CDS Start-End: 260-457
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggat

SEQ ID NO: 177671 - DNA, 588 bp, Homo sapiens
  Payload ID: 14867
  Gene Symbol: RBM23
  Gene Name: RNA binding motif protein 23
  ENST ID: ENST00000554618
  CDS Start-End: 362-588
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactgagtcttggtctgtcacccaacctggagtgcaatggtgccatctcggctggctgcaacttccgcctcccgggttcaagcaattctcctgtctcagcctcccaggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcag

SEQ ID NO: 177672 - DNA, 808 bp, Homo sapiens
  Payload ID: 14867
  Gene Symbol: RBM23
  Gene Name: RNA binding motif protein 23
  ENST ID: ENST00000553884
  CDS Start-End: 1-643
ggctgactgggcagcggttgctgggagtgcctatcattgtacaggcttcacagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcct

SEQ ID NO: 177673 - DNA, 387 bp, Homo sapiens
  Payload ID: 14867
  Gene Symbol: RBM23
  Gene Name: RNA binding motif protein 23
  ENST ID: ENST00000557245
  CDS Start-End: 1-249
ctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtgagtctcagggtctagctcattctagcctttgattattctctttcctttggcttcccatttacctcttctttccacaggtaaatcagtggcacagtatactgcctccttgtgcctctggatcctgccacttcacatctac

SEQ ID NO: 177674 - DNA, 826 bp, Homo sapiens
  Payload ID: 14867
  Gene Symbol: RBM23
  Gene Name: RNA binding motif protein 23
  ENST ID: ENST00000557403
  CDS Start-End: 483-826
cattttgcgggaagaggaggctctgtacctgcagtgctgcttttcttgcctagactctaggaactatccgagctccactccccacaacatactcaaaggaacggagagaaccgggacccccctgcggggacccggaactggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaaggttcgcgatgtacgtatcatctcagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagcc

SEQ ID NO: 177675 - DNA, 573 bp, Homo sapiens
  Payload ID: 14867
  Gene Symbol: RBM23
  Gene Name: RNA binding motif protein 23
  ENST ID: ENST00000557571
  CDS Start-End: 301-573
agagctgccgccattttgcgggaagaggaggctctgtacctgcagtgctgcttttcttgcctagactctaggaactatccgagctccactccccacaacatactcaaaggaacggagagaaccgggacccccctgcggggacccggaactggccgggctcggtggctcatgtctgtaatcccagccctttgggaggaccaggcaggcggatcacctgaggtcaggagttcgagaccagcctgaccaatgtggagaaaccccgtctctgctaaaaatacaacattagccagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaatcgtagtcgagatcgggatcggtatagacggagaaatagtcggagccgaagtccaggtcggcagtgtcgtcaccgtagccgtagctgggatcgt

SEQ ID NO: 177676 - DNA, 571 bp, Homo sapiens
  Payload ID: 14867
  Gene Symbol: RBM23
  Gene Name: RNA binding motif protein 23
  ENST ID: ENST00000555691
  CDS Start-End: 400-571
attacaggtgtgtgccaccacacccagctaatttttatatttttggtagagggggtttcgccatgttggccaggctggtctcaaactcctgacctcaggtgatctgcctgccttgccctcccagagtgctaggattacaggtgtgagccactgcgcccggactatccttgactgttccaagccacaaagtcgaactagttcagatctatagggtgtaaaaataaacctagagtaagtgacagctggtaaggtttctttgcagttcaagaaacagaactgaaatctgtatatcctgaagtctctttcttggagtgggaaagaaatgtgtggtgctggaaagggaggaaaaatataaaacagattcttacatattaatatcctctccccagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggaga

SEQ ID NO: 177677 - DNA, 569 bp, Homo sapiens
  Payload ID: 14867
  Gene Symbol: RBM23
  Gene Name: RNA binding motif protein 23
  ENST ID: ENST00000556862
  CDS Start-End: 292-569
aagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatggaatcttgctctgtcacccaggctggagcacagtggcgcgttctcggctcattgcaacctccacctcctgggttcaagcagttcttatgccacagccttccaagcagctgggactacagatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaag

SEQ ID NO: 177678 - DNA, 581 bp, Homo sapiens
  Payload ID: 14867
  Gene Symbol: RBM23
  Gene Name: RNA binding motif protein 23
  ENST ID: ENST00000554256
  CDS Start-End: 150-581
attttgcgggaagaggaggctctgtacctgcagtgctgcttttcttgcctagactctaggaactatccgagctccactccccacaacatactcaaaggaacggagagaaccgggacccccctgcggggacccggaactgatctgacaggatggcatctgatgactttgacatagtgattgaggccatgctggaagctccctataaaaaagaagaggatgagcaacaaaggaaagaagttaaaaaggattatcctagcaataccaccagcagcaccagcaacagtggcaatgagaccagtggaagcagcaccatcggggagacaagcaagaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggag

SEQ ID NO: 177679 - DNA, 2278 bp, Homo sapiens
  Payload ID: 14867
  Gene Symbol: RBM23
  Gene Name: RNA binding motif protein 23
  ENST ID: ENST00000555209
  CDS Start-End: 624-1193
ggaagaggaggctctgtacctgcagtgctgcttttcttgcctagactctaggaactatccgagctccactccccacaacatactcaaaggaacggagagaaccgggacccccctgcggggacccggaactggaagaagaggagtcggagccataataaaagcagggatagaaagcgcagtcgtagtcgagatcgggatcggtatagacggagaaatagtcggagccgaagtccaggtcggcagtgtcgtcaccgtagccgtagctgggatcgtcgacatggtagtgagtcgcgaagtcgggaccatcgtcgtgaggatcgtgtgcattacaggagtcctccacttgccactggggagccagttgataatctgagtcctgaggagcgtgatgcccgcacagttttctgtatgcagttagctgcccgaattcggcctcgagatctggaggactttttctctgctgtaggcaagatcggaactcacgtcgttctaagggcattgcctacgtggaattctgtgaaatccagtctgtgccactggccattgggctgactgggcagcggttgctgggagtgcctatcattgtacaggcttcacaggcagagaaaaaccgactggcagccatggccaacaacctgcaaaagggcaatggtggaccaatgcgcctctatgtgggttccctgcacttcaatatcactgaagacatgctccggggcatctttgagccctttggtaaaattgataatattgtcctgatgaaggactcagatacaggccgctctaaaggttatggtttcatcacgttctctgattctgagtgtgcccggcgggccctggaacagttgaatgggtttgagcttgctggtcgacctatgagggttggccatgtgactgagcgactggatggtggcacagacatcacttttcctgatggggaccaggagctggatctgggatcagcaggtggacgttttcagctcatggcaaaactggcagaaggcgctggaatccaactgccaagcactgctgctgctgctgctgccgccgccgcccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtcccactggaaatggactctgctgagcaaagccaccagttgaagagaacagaatccacacctgcattgaatacctgtttctccatgtgtatcgtctctgagattaccttcttgccctttccaacaccttagtgattcctcaatttctcccccattgggaaggccatagggcatactgaaggaactgacctctctccttttcctgtacctttaacctttagtctgtcaaggaaaacccttaggacctctgaatcaagaggactgagtttgtgggtgaaccttgaaggtgctctttctgctacaagggccctgggagatagcatggacgtgcattgagaagccagcctcagaccttagcttgaagcagcttgaggccagacctactgtagcctcagcatcttgctaggaggcatggaagtgatctatcctgccaggaggcctcagagtgatctgtcctgccaggaggtgtgagagtgatctgtcctgtgaggcatttaggggctttcaggaatttagtaaaaggtggagtatgcctttccagtatcttccatcttcctttgtatacttgtccttcctcccatttcctccctttggcccgaggtaggaggatggagggaggctgctactctaccacttcctgtgtgcctctactgtggcctcaaccctggcaattatagctactcccatcccttacctgggcatgtgtgagcccttctcactggattttatacccttgtgtctgtgtacataaatatatatacatatatatatacataaaaactttgtacaaaaggcaagcctcctccttgtggcagctgttgcccatttgtgtgtggtctttgttgtgtgtctgacaacttctcattagcccaacttatgatgtttctagggatataaaacattagtaacatca

SEQ ID NO: 177680 - DNA, 2394 bp, Homo sapiens
  Payload ID: 14868
  Gene Symbol: RBM24
  Gene Name: RNA binding motif protein 24
  Uniprot ID: Q9BX46
  ENST ID: ENST00000318204
  CDS Start-End: 72-647
gatctcagttttatcatgaatgacttctccattgtgattcttgatttccttcatgggttaatttagaggttatgtatgtatgtctgtgtgtgtctgttgctaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataattttt

SEQ ID NO: 177681 - DNA, 2703 bp, Homo sapiens
  Payload ID: 14868
  Gene Symbol: RBM24
  Gene Name: RNA binding motif protein 24
  Uniprot ID: Q9BX46
  ENST ID: ENST00000379052
  CDS Start-End: 237-947
ggagagagcgaagtcaagtctccagggccgctggcgacttcggaagccgcgcgcccggcgctctcggccgcccccggccgctcgcccccgccgcgccgccgccctcgcccccgggctcgcccttggcccccggcggccgcgaaagggtgcgggagacgcggagccggaggaggaggcgcagccgctgcccgagccgcagccgcagccggagcccgagccgcggggcgggtgcgaagatgcacacgacccagaaggacacgacgtacaccaagatcttcgtcggggggctgccctaccacaccaccgacgccagcctgcgcaagtacttcgaggtcttcggcgagatcgaggaggcggtggtcatcaccgaccggcagacgggcaagtcccggggctatggatttgtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcagaactgtcttaaggacatttattttttttccctttttaagtaattttacactttagtatctatttcagagtcatatttaaaactatttattagtgactacagtacatgagacaacaaggttactgagattacaattcttcaaaggttaatgataatgtggtttatactgtgccttaatagtaatgctatttaagatatttatttttaagttttactatgctgcactctaaagaaaggaactttagatgtgacactgtaaaattatgtattcatctcatggcataaattatttagtaagtctagatgtagcgtattaaatattaacctattcaactaaagatgttgacttggatttatttaaattcatatgtgcactgtataagagagtactcttacattaacacattttagtttagtttttagatttttttttaaacgatatattgctagtttcatgcttcctcctctgattttgcctgtgtagatttcatttattggtaattcattagtttaacactattatgtagtttttaaatgctgctttacatttttcttctgaaactgcaatacttgcaatttttattcttaaactaaattgaatactattttacactgtattggatttttatacttgaacaatttcatacaagggaagacaggttagcatttttatggactttctccattatcactggatttactttaagtattcccatactagacagtgttatgtaatgtagacatgactctcctgtgcaaattatttattcgttgtgtatattgctttataacatttcagatcttctaatctattcacttgtattaaatataatttttaaaaacttc

SEQ ID NO: 177682 - DNA, 1034 bp, Homo sapiens
  Payload ID: 14868
  Gene Symbol: RBM24
  Gene Name: RNA binding motif protein 24
  Uniprot ID: Q9BX46
  ENST ID: ENST00000425446
  CDS Start-End: 163-699
acaattgcattcccgggctggatgccggttgttaagcgcgctgttgctttgtaaaaatgcgtgtgttctggtgttttggctggggcagggaggggacaccccacgaggtctggggctgttgcccttgtgtcatccccccgccttttaactgcaaaggtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaa

SEQ ID NO: 177683 - DNA, 622 bp, Homo sapiens
  Payload ID: 14868
  Gene Symbol: RBM24
  Gene Name: RNA binding motif protein 24
  ENST ID: ENST00000503965
  CDS Start-End: 1-605
agagtaggacaatagctattgtcgttggggagtgttttcgaggttgggagcgttgggcggatgtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcgggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaa

SEQ ID NO: 177684 - DNA, 1544 bp, Homo sapiens
  Payload ID: 14868
  Gene Symbol: RBM24
  Gene Name: RNA binding motif protein 24
  ENST ID: ENST00000509686
  CDS Start-End: 1-243
gtcatcaccgaccggcagacgggcaagtcccggggctatggatttgtcaccatggctgaccgggctgctgccgaaagggcctgcaaggatcccaatcccatcattgatggcagaaaggccaacgtgaacctggcatacttaggagcaaaaccaaggatcatgcaaccaggttttgcctttggtgttcaacaacttcatccagcccttatacaaagacctttcggagataaacaagctggctgaccctcaggtgcctgatagtcaaacaggatacctgcccactatgtctatccgcaggcttttgtgcagccgggagtggtcattccacacgtccagccgacagcagctgccgcctccaccaccccttacattgattacactggagctgcatacgcacaatactcagcagctgctgctgctgccgccgccgctgctgcctatgaccagtacccctatgcagcctctccagctgctgcaggatatgttactgctgggggctatggctacgcagtccagcagccaatcaccgcagcggcacctgggacagctgccgccgccgctgcagcagctgctgccgctgcagcatttggccagtaccagcctcagcagctgcagacagaccgaatgcaatagaccagccatctgatcaaagttgaattgttttctctttccctcccaattttccaatttttagtagctaataagagagttaacattgacttaacagctttaaaaaaaaaaacagccatgctattgtgaagcagagttattattttttttatactccaggtagtgttctagatgagaaagaggtaagaatgaggggaatgggcacaattttggaaatcaatcccaaagagcctgagtaaatgaaaggccactacgaaatgacgccaggagtaacaacggaacttcacttttgtaacgggatttttatttttgctctttttatagtatcagggaagcaaactgccttttacaagttagaaaatgctgtttgaatctagttgaaccagggaatacagagcgagcaatatgtagcttgaattacatttaaaagcagattttttacaaacaaaatggcgaaagcactgattgtcatttttagcagtcacttaaggcctatagaacttttttcaagtcggaaggtcctgttcttactatctcaaaaatgggcatcgaacaatcaatctaggagcgtggcagtgggtaaaatggtggacaggcaccaaagctattttctcatctgtcctgtggatgagtggaactgtggaacaagtgatgtggaattaatgggtgcaacagctgtacagacaatcaataacacacacagttctggaaagaacacatcacttgtgcttgtttgatgagcttgtcacattctaatccctctccccatcctgtttcaattttgggaaacttgtatctgctggtgtcagcaattctgattctgaaataggatcaggcttttactacaacagccttctctttctatttattgtgtcgactcgtggcttatgaataaaggcaggcaaagtttgcag

SEQ ID NO: 177685 - DNA, 6910 bp, Homo sapiens
  Payload ID: 14869
  Gene Symbol: RBM25
  Gene Name: RNA binding motif protein 25
  Uniprot ID: P49756
  ENST ID: ENST00000261973
  CDS Start-End: 286-2817
tggtgagtcagagccaacagcggagacgatctatatacgttcttctctatggttccgcgctccccgcccccggccgcagtgcacgccgggcaagaggaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtccttaaaacatttcccaactaaagaatagaattgtaaaggaaaagtggtactgttccaacctgaaatgtctgttataattaggttattagtttcccagagcatggtgttctcgtgtcgtgagcaatgtggtttgctaactggatggggttttcttattaataagatggctgcttcagcttctcttttaaaggaatgtggatcatagtgatttttccttttaattttattgctcagaaatgaggcatatcctaaaaatcctggagagctgtatttaatgcatttttgcactaattggtccttagtttaattctattgtatctgtttatttaacaaaaaattcatcataccaaaaagtgtaagtgaaaaccccctttaaaacaaaacaaaaaaatgaaataaaattaggcaaattgacagacagtgagagttttacaaacatgataggtattctgctcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgcttagagaaattcctggggctttcttcgttgtagatcagaatttcaccagggagtaaaattacctgaaaacgtaagaagttttaaacagcttttcacacaaattagatgcaactgttcccatgtctgagtacttatttaaaagaaaggtaaagattggcctgttagaaaaagcataatgtgagctttggattactggattttttttttttttaaacacacctggagaggacatttgaaaacactgttcttaccctcgaaccctgatgtggttccattatgtaaatatttcaaatattaaaaatgtatatatttgatcctggggactcatattctttcagaatcatgtaaataaatggcatcatgttgtaattgtgtggtgcatactagaaaagttaaaaatatgggctgaactttttatggacttgatttttatgactattggtatctaaaggtcaaggaagccatttacattattttggatgaatctactatacatctatggaaatgtctcttttattttaaattctggtttctcaacggaaaatttcagaaaagatgccccttgccattttcgttaatttttcagtcttttcttagacacacccccagcctaagaccttgttcgaggagtttattgtgtctgtcttttcttaacatactgcactgttcttaagcatcatattgtgttgtttttatttagccactattaacatgaaggtttattcaggtagatttgatttcctttgcttcgtttcttctcctgctctgtcaactgtacttatcttaaagggccactctaaaaacaagggagatgtcgtaatctgaaacctttggggagatgtactctgtactgcataacatctccagtgaggtttgtgacaggacctcaactaaatatatgaatttgtgcaagttcatatattaaagtttctgcagcagagtgaaaattgttacagtaaatgtggtagaaactgttaatcgcttaatgccagtttaaatcatgttttgtaaccaagcttcagtaaaaggctttagattgtcagagttggttgatttttagaattgtatatataaagaattagacattaaacaggcatattctagtgtctgaaaatacacataagaaatttctattaagttgcttgaactttgtgggttaattttaccataatctcataaattaattttagtttgaaaaccttatacagtatgaattcattttgccatttcaagttgttatataaagagcatgaaagtctttttttgttgtttttttggggtttttttttttttgagaggaagttgtgcttttgtcgcccaggatggagtgcaatggcgcgagctcagctcacttcaacttccgcctcccgggttctggagatattctgcttcagttttctgagtagctgggattacaggtgcccaccacgacacctggctaattttttgtatttttagtagagacaggatttcaccttgttggccaggctggtctcaaactcctgacctcaggtgatccacccgcctcagcctcccaaagtgctggtattacaggcgtgagccaccttgcctggccaaagcgtgaacatcttaagaaccagtcttgatctggcaaaaaagtagtagaatactacttttctttatttgtccctaaaaataaagtatgtacatctgttcacaaggaagaaaggtaagtttgaagttgtttttcttaaactttaatgtgaccccaaatcatctgaggagtgcttgtagaaatagagacactgaagtagcagcgctggggtggcgccgcaggctttgcatttctggacagctcccagctaatgtcattgccaactgatccaagactacattttgattagcactttaaggtgtctattcagtattattttatcctaacagactacataaatgcagctgaattttcctttaagtagattttaaagagaaaaacattttttgaggcaaatacacgtaactcatgaacgtaatgtaatcttgcaaaattatgtctgagaaagccctaatattctaggctttttttccatccagccctgaaaattttttctgtagataactttatgttgtaacttattctgaatcttattatggcatttccctgtaaactatgtaagtgtaagctaatgattattttgtgaagcgtgctgtttcaggtattaatctgccatgaatactagatatagtagaaaaactgagaaaacatttagcttgagagccaatttgaactagacactatctttttttctcctttttaatggaataaatttaatgcaaataagtgtaagcaggtatacaatgtttagatgaggcttattttcccaactctttttaacaggttttatgatatccccaatttatacccaaaagactgctgagaggttttatgtcaaattgattacaaacttctctgggttgtatttcagtcttctgttaagtatgaaattgagaaatagttttgctcaacaaaagatgatgagggattgatttgtgaatgtcactggagataaaagggtatgagaaggaatcccaagcaggcaaagaaacagtctagctgtcaagaagaaaacagggagatacataccaaacccaggagctactaatataacaatcatactatagagcgaagtgaacttacactttttgataaactgatagattttttgtaatgtgattatggtaaaatactgaaatatttatgttaatttatttgcatttgaatgcttacatttttaattgacagaatctttgcatttcattacttgagtcatgaaggcgaaattaaagaatggcagtctaaaatacccaggtaaagaagataatttctagaaacaaaaataaaaattcttttcaagccatgttgtttgaattaaatgac

SEQ ID NO: 177686 - DNA, 3375 bp, Homo sapiens
  Payload ID: 14869
  Gene Symbol: RBM25
  Gene Name: RNA binding motif protein 25
  Uniprot ID: P49756
  ENST ID: ENST00000527432
  CDS Start-End: 258-2789
gaagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggggtctttctctgtctctcagcctcaagccatcctcctgcatcagcctcccaagtagttgggaccatagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactctcttttgatcagaaatggcaagcccttgtgaaggcatggagtttaaaattggaatgcaaaaattagcagacaatccattcctactgtatttctgtatgaatgtgtttgtgaatgtatgtgtaaaagtctttcttttccctaatttgctttggtggggtcctt

SEQ ID NO: 177687 - DNA, 541 bp, Homo sapiens
  Payload ID: 14869
  Gene Symbol: RBM25
  Gene Name: RNA binding motif protein 25
  ENST ID: ENST00000525161
  CDS Start-End: 160-541
agaaggtcgcgaaggcagtaccgtttcctcagcggcgggtgagtttgtgtctctgaacgcgtgtggaaaccgggagaccgggtgcctcagctggtggaggaggaaaagccggggtggctgcgaaagcgccagggtggggtagagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaag

SEQ ID NO: 177688 - DNA, 1039 bp, Homo sapiens
  Payload ID: 14869
  Gene Symbol: RBM25
  Gene Name: RNA binding motif protein 25
  ENST ID: ENST00000531500
  CDS Start-End: 311-1039
aagacctccatcagctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggacggagtcttactctgtcgttcaggttggagtgcagtggcgcgacctcggctcactgcaacatctgcctcccaggttcaagcaattctcctgcctcaccttccagagtagctgggattacagactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggac

SEQ ID NO: 177689 - DNA, 3008 bp, Homo sapiens
  Payload ID: 14869
  Gene Symbol: RBM25
  Gene Name: RNA binding motif protein 25
  Uniprot ID: P49756
  ENST ID: ENST00000528081
  CDS Start-End: 6-500
taagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatggggttgggatgaaagtagtaagggaggctggacaaggttaacttgccagagaaagcactggtacagactattccaaacagagctaattcattaaggcagctttgtaaaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagaaactggaagaagagaaaggcaaaaaggaaaaagaaagacaggaaattgagaaagaacggagagaaagagagagggagcgtgaaagggaacgagaaaggcgagaacgggaacgagaaagggaaagagaacgtgaacgagaaaaggagaaagaacgggagcgggaacgagaacgggatagggaccgtgaccggacaaaagagagagaccgagatcgggatcgagagagagatcgtgaccgggatagagaaaggagctcagatcgtaataaggatcgcagtcgatcaagagaaaaaagcagagatcgtgaaagggaacgagagcgggaaagagagagagagagagaacgagagcgagaacgagaacgggagcgagagagagagcgagagagggaacgggagcgagaaagagaaaaagacaaaaaacgggaccgagaagaagatgaagaagatgcatacgaacgaagaaaacttgaaagaaaactccgagagaaagaagctgcttatcaagagcgccttaagaattgggaaatcagagaacgaaagaaaacccgggaatatgagaaagaagctgaaagagaagaagaaagaagaagagaaatggccaaagaagctaaacgactaaaagaattcttagaagactatgatgatgatagagatgaccccaaatattacagaggaagtgctcttcagaaaaggttgcgtgatagagaaaaggaaatggaagcagatgaacgagataggaagagagagaaggaggagcttgaggaaatcaggcagcgccttctggcagaagggcatccagatccagatgcagagctccagaggatggaacaagaggctgagaggcgcaggcagccacaaataaagcaagagccagaatcagaagaggaggaagaagaaaagcaagaaaaagaagaaaaacgagaagaacccatggaagaggaagaggagccagagcaaaagccttgtctgaaacctactctgaggcccatcagctctgctccatctgtttcctctgccagtggcaatgcaacacctaacactcctggggatgagtctccctgtggtattattattcctcatgaaaactcaccagatcaacagcaacctgaggagcataggccaaaaataggactaagtcttaaactgggtgcttccaatagtcctggtcagcctaattctgtgaagagaaagaaactacctgtagatagtgtctttaacaaatttgaggatgaagacagtgatgacgtaccccgaaaaaggaaactggttcccttggattatggtgaagatgataaaaatgcaaccaaaggcactgtaaacactgaagaaaagcgtaaacacattaagagtctcattgagaaaatccctacagccaaacctgagctcttcgcttatcccctggattggtctattgtggattctatactgatggaacgtcgaattagaccatggattaataagaaaatcatagaatatataggtgaagaagaagctacattagttgattttgtttgttctaaggttatggctcatagttcaccccagagcattttagatgatgttgccatggtacttgatgaagaagcagaagtttttatagtcaaaatgtggagattattgatatatgaaacagaagccaagaaaattggtcttgtgaagtaaaactttttatatttagagttccatttcagatttcttctttgccacccttttaaggactttgaatttttctttgtctttgaagacattgtgagatctgtaattttttttttttgtagaaaatgtgaattttttggtcctctaatttgttgttgccctgtgtactcccttggttgtaaagtcatctgaatccttggttctctttatactcaccaggtacaaattactggtatgttttataagccgcagctactgtacacagcctatctgatataatcttgttctgctgatttgtttcttgtaaatattaaaacgactccccaattattttgcagaattgcacttaatattgaaatgtactgtataggaaccaacatgaacaattttaattgaaaacaccagtcataaactattaccacccccactc

SEQ ID NO: 177690 - DNA, 898 bp, Homo sapiens
  Payload ID: 14869
  Gene Symbol: RBM25
  Gene Name: RNA binding motif protein 25
  ENST ID: ENST00000532192
  CDS Start-End: 1-221
taaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgt

SEQ ID NO: 177691 - DNA, 1567 bp, Homo sapiens
  Payload ID: 14869
  Gene Symbol: RBM25
  Gene Name: RNA binding motif protein 25
  Uniprot ID: P49756
  ENST ID: ENST00000526754
  CDS Start-End: 173-1057
cgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataagagatcatatggtgactaatgcaagatgaaactctcagcttggaaagtaacaaggaataggatttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaa

SEQ ID NO: 177692 - DNA, 2470 bp, Homo sapiens
  Payload ID: 14869
  Gene Symbol: RBM25
  Gene Name: RNA binding motif protein 25
  Uniprot ID: P49756
  ENST ID: ENST00000525321
  CDS Start-End: 175-1077
ctcgccgcgcagcgcggctgtatttgcggcctgtgcgagtaggcgcttgggcactcagtctccctggcgagcgacgggcagaaatctcgaaccagtggagcgcactcgtaacctggatcccagaaggtcgcgaaggcagtaccgtttcctcagcggcggactgctgcagtaagaatgtcttttccacctcatttgaatcgccctcccatgggaatcccagcactcccaccagggatcccacccccgcagtttccaggatttcctccacctgtacctccagggaccccaatgattcctgtaccaatgagcattatggctcctgctccaactgtcttagtacccactgtgtctatggttggaaagcatttgggcgcaagaaaggatcatccaggcttaaaggctaaagaaaatgatgaaaattgtggtcctactaccactgtttttgttggcaacatttccgagaaagcttcagacatgcttataagacaactcttagctaaatgtggtttggttttgagctggaagagagtacaaggtgcttccggaaagcttcaagccttcggattctgtgagtacaaggagccagaatctaccctccgtgcactcagattattacatgacctgcaaattggagagaaaaagctactcgttaaagttgatgcaaagacaaaggcacagctggatgaatggaaagcaaagaagaaagcttctaatgggaatgcaaggccagaaactgtcactaatgacgatgaagaagccttggatgaagaaacaaagaggagagatcagatgattaaaggggctattgaagttttaattcgtgaatactccagtgagctaaatgccccctcacaggaatctgattctcaccccaggaagaagaagaaggaaaagaaggaggacattttccgcagatttccagtggccccactgatcccttatccactcatcactaaggaggatataaatgctatagaaatggaagaagacaaaagagacctgatatctcgagagatcagcaaattcagagacacacataaggtagtattcttgtcttttcacttgataccaatctagactttttacagaatccaaagcaaagagacaaaaaaaatcaaccttaaattagaatataattttaaatgttttttataggtttaattgatatttagatagaaaaaagaaacagaagaccaataccatattaaagtggtccttgacatgttgtgcttagttttttcagttactgactattctgcagtcatctcactttaatatgaatagaagctaattttatttttagatttcaacataaacatcaaggtcagacttaaattagattcagggggcagcaggataacatacactgtagtgtatttctgggggcagttatttaacttgatcttaggaataccttttctttagagctgagattaaaatttacattttatatttgtatagatttaagttgagtgggggagattttaaacagtaggtcagtggttaccagacttaccaaattttagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtatttatgcatagtaaatcccactcacgagttttgcctatttgaagcttctctcaatgacagtgcatctgtgaatgttcgctggtgttgaaaatgatgcttttgaacggtgcaatgcaaacactgcatgaaatgtattttgatggtcgagataataaggtgttgctggttcttactgatagactgagagatctttaactcagtgaaatgttaaatgttcattttctcttttattcttactttttcccattgctttcaaaatctgcagttcacaaataatgccaatgaatcagtgctgctgaacacttactatccagatgcccagcccttgctcacaaacacaatgctttttcaagaattaaatgtgtctaagagcacaaacataattctcccaaaattaattttgagagttgaaaaggtggtctatgggaaatcattttagatgaataattttggttaggtataatactgaaattcaggaccgagtaagcttaaaaatggtatatggttgtgtgtgtggtttaccccctttttgtttttatttatttgttaaaccctgtcatgttattggtaaattatgaggaaatcatgttttaagaaaaattcaaaaatatatttgctttaaagtttgggaatctgttaggcattttactgccttagtattatttcactggagggaatgttttgaattttcagaatgtcttttcaaaataaaaagaaatcaaaatgaaaaa

SEQ ID NO: 177693 - DNA, 3624 bp, Homo sapiens
  Payload ID: 14870
  Gene Symbol: RBM26
  Gene Name: RNA binding motif protein 26
  Uniprot ID: Q5T8P6
  ENST ID: ENST00000267229
  CDS Start-End: 15-2957
tagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaa

SEQ ID NO: 177694 - DNA, 4132 bp, Homo sapiens
  Payload ID: 14870
  Gene Symbol: RBM26
  Gene Name: RNA binding motif protein 26
  Uniprot ID: Q5T8P6
  ENST ID: ENST00000438737
  CDS Start-End: 442-3465
gctgggagccgggaagaccccctgaatcgttcccattgagctgcccttcgccttcgctttctttacttttgccttttcgacgtagccaacaagcacctggtcccgaggctgagagaaggctcgggtctaagcgcgtgtcgcgcttccggtctgggtagatttgctggggaagagggaagggggagggcccgggcaaaccgttgctgtttcagcccgggctgggggccggggacggggagctcctggcaccccgtgcacttgtggcctgcggcggtccttgcagagctgttcgccgaccggggcccgcgggaacctgccaccggcgcctcccaccgcggcccacgcgggcggcgcgcggaggagggggcgggggcagcggcggctgtagcggccgcgacctgggcgggcggaggagtgtgacgggccttagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaaggtaatgcagcctttagtccagcagcccattttgcctgttgtgaagcagtcagtcaaagagcggctgggtccagtaccttcaagtactattgaacctgcagaagcccagagtgcctcttcagaccttcctcagaatgtaactaagttatctgtgaaggacaggttgggttttgtatcaaagccatctgtttcagcaactgaaaaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaa

SEQ ID NO: 177695 - DNA, 5152 bp, Homo sapiens
  Payload ID: 14870
  Gene Symbol: RBM26
  Gene Name: RNA binding motif protein 26
  Uniprot ID: Q5T8P6
  ENST ID: ENST00000438724
  CDS Start-End: 448-3399
gggggtgctgggagccgggaagaccccctgaatcgttcccattgagctgcccttcgccttcgctttctttacttttgccttttcgacgtagccaacaagcacctggtcccgaggctgagagaaggctcgggtctaagcgcgtgtcgcgcttccggtctgggtagatttgctggggaagagggaagggggagggcccgggcaaaccgttgctgtttcagcccgggctgggggccggggacggggagctcctggcaccccgtgcacttgtggcctgcggcggtccttgcagagctgttcgccgaccggggcccgcgggaacctgccaccggcgcctcccaccgcggcccacgcgggcggcgcgcggaggagggggcgggggcagcggcggctgtagcggccgcgacctgggcgggcggaggagtgtgacgggccttagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaaggtaatgcagcctttagtccagcagcccattttgcctgttgtgaagcagtcagtcaaagagcggctgggtccagtaccttcaagtactattgaacctgcagaagcccagagtgcctcttcagaccttcctcaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttggtaagtgttccagtctgatattttaagtgtgtacttcctatacttgtataaaaatctttgatgtttgcaacaatactgtgatttttttaagtggatttcttttgcaagtgaacatgatcattgaaagttgatatggcagtttccaggaaataaatgcattctttgtagaatgggggtgggagattacatatttatattttcaaattcatcattttgattgcaagtgtttctgcctctcttgagattatagtgataatattaaaaaatcacatttaaaaaattactttcttccatattggggtcctcacaatcaaaagctgttgttccaccaccaccatagtcttctgccagtggagtaacttaaggatgctgttctttttcttcttccccatacacccctaattggggttgaagttgtgtgtattttcttgatggtaacactatttcatagaaatgctttgccttgcaattcgtgtctacgtttatatttaaaatttcaaaatcagatttcagttgtcaaaatagtgactttgctcaaaaagtcactatttttacttatatatttaaatcaaagatctatttttatgtagtctcttgtatgttgactatgtgctattctgattcattaggtaagtttgttttcttttctttttagtagtcgtgaaag

SEQ ID NO: 177696 - DNA, 3662 bp, Homo sapiens
  Payload ID: 14870
  Gene Symbol: RBM26
  Gene Name: RNA binding motif protein 26
  ENST ID: ENST00000449987
  CDS Start-End: 1-516
cttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaacagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaaaccaacaaagaaaataattttcttccaagtgacaaatgatgatctgtggattataaatattttaaaaattatatgtcttaacataattttttcacatttttttgactttcaatcaagacatcgaagacgacctttaaagcaagaggaaatagtgttgtgtgcctaacattggtaaagactagtttttaaccattttaagaagtgtatgtccaaattatttataagcagtatgacttaatatggcttagaattacttataaagaatctgattaaatctcatcctaaatatgtagccacaatatcttttttataatgggactataagaaatgtttgcacttagtttctgagtattccttcatagattctcaggaggcatttaaaaagttggaagctatacttggtagtaactatattagaaaagtccaattgacactgatttttattcacccttgttttatttttatccagccatactacctttatcacttttttttttttttttggtgcaaagcttaacattctgcaaactttttttccccttgagtatgcattgcatttgtcatgaagagtaaaaagaatgtaataaacacatcagtcataatgtaaattaactgttttgatccacattggttggatacagcatggttaattctaggcttggttaaaaatacataatttggaaagtcttctaatattttaaagacctagtagtttacaaggcctttttttgttgttgttgttagacttttggttcacatttacaaactagccacagggtgttcataaatatttccccaaattagttgagtatttttaattgtaaacaaagaattttctgcccctactacactggtttactgctagggtaaagaccattgtctgaagacactaaacttggtgttaacagtgttgattgtttaatggatatggactacatgccactacctgcaactttgtcatcctggagtttttgtttggtttggtttgatttttcactttttgcttttaaaattaaaaacaaagcaaaacaaaattgaagataccattgagaatcagaattcaagatgacttgattctcactaagatcactgcgcttttttaaaattgctttgagatctagtcagttacatatttaaaatccccgtgttgattagagataaggttttcattattttattttcctaaataggattctcatggagctattgtagataactgtacagaatcacttttgtgtaattgaatgaagcagtttcctctgcatgattgcataatgaaagccttttatatatctatatttttcaatacttagattttacactattaagctgctctagtcatgctatatttgtttttttaatagagtttataaatatttatgctcaaaatacagatcaactgaatatttttggtcttgtttacaagataaatcatactttaaaatgatacaggcccctcaagtgtcttaggaaaaagtcattggtgctataaaacctttcagtatcatttttgaacccattgttcagactttgctaggttttaatctgattccttgtgatttattataatgtagcagcatacttataaaagtggtctgtgctgagtcagatagagagcccagcccattagaaacacatcataatttaagaatatgatgcagaatgcccttacacttatttgtgcccagcttcccaaaaagaaaattgttttgttaagaggaaggcagttaatttggctagaatccaaaaactcattcagcatggctgttttcccttatttcaaatgaaaaacttttctaatactaaaatatgtaatcctgctttgctttaaattcccatgtctgtcactcaacaggaggcatagtgattcttaaatatttacggaacatttggtgagttgtaaagagaagtattattgcattgtaggtttttgcattgatgtgtcgatttttttgttttgtcccaagatttccttccagcaccttaatgaatgttcatatgatagaatgttttaagtatcagcaaagcattcatggatgcctgcttttcattctcagaaggctaaacctgttttgggtatgatgctacttcagaacatattgtctggcacaagatttcttctaataagtggtttatttaaactcaatttcggtggactgttgaattgaaaaacaccaaaggagtcttcttgtctggagactggattgttccagttttaaatacctgtgcccataagtatcccatttcatgaatgtgtgttggcatggggaaaaaatttccctgctctttgagtggagcgaaagcaattggttaagctgtagcagcttttttgtttatttttttaaagtaataataaaacttgaactgaaaaaagataaaacttgaactagaatactactcttgtatgcttagaatgtttatagtgttaaatgtttatgtggggttgtcaacatttttattatttatagttgaattatgttttgttaaatccatattgtttattatttttatattttgaaaatttttaaaataaaagtcttactaaaaacagtt

SEQ ID NO: 177697 - DNA, 5230 bp, Homo sapiens
  Payload ID: 14870
  Gene Symbol: RBM26
  Gene Name: RNA binding motif protein 26
  ENST ID: ENST00000622611
  CDS Start-End: 448-3477
gggggtgctgggagccgggaagaccccctgaatcgttcccattgagctgcccttcgccttcgctttctttacttttgccttttcgacgtagccaacaagcacctggtcccgaggctgagagaaggctcgggtctaagcgcgtgtcgcgcttccggtctgggtagatttgctggggaagagggaagggggagggcccgggcaaaccgttgctgtttcagcccgggctgggggccggggacggggagctcctggcaccccgtgcacttgtggcctgcggcggtccttgcagagctgttcgccgaccggggcccgcgggaacctgccaccggcgcctcccaccgcggcccacgcgggcggcgcgcggaggagggggcgggggcagcggcggctgtagcggccgcgacctgggcgggcggaggagtgtgacgggccttagggccgctgtggatggtttctaaaatgatcattgaaaacttcgaggcactcaagtcctggctcagcaagactctcgagcccatctgtgatgcagatccatccgccctagcaaaatatgttctggctttggtaaagaaagacaaaagtgaaaaagagttaaaggcattatgtattgatcagctggatgtatttcttcagaaagagacacagatatttgtggaaaaactttttgatgctgtgaatacaaagagttacctacctcctccagagcagccatcatcaggaagcctgaaggtagaattttttccacaccaagaaaaagatataaagaaggaagagatcactaaggaggaagagcgagagaagaagttttctagaaggctaaatcacagtcctccccagtcaagctcccgatacagggaaaatagaagccgtgatgagaggaaaaaagatgatcgttctcgcaaaagagattatgatcgaaaccctcctcgaagagattcatacagagaccggtacaatagaagacgagggcggagtcgcagttatagcaggagtcgaagtcgaagttggagtaaagagaggcttcgtgagagggacagagatagaagcaggactagaagcagaagcagaacacgaagcagggaaagggatctggtaaaacctaaatatgacctggatagaacagatccattagaaaataattatactccagtctcttcggtacctagtatttcatctggccactaccctgtacctactttgagcagcactattacagtaattgctcctactcatcatggaaacaacactaccgaaagttggtctgaatttcatgaagaccaagtggaccataactcttacgtaagaccacccatgccaaagaaacggtgtagagactatgatgaaaagggtttttgtatgagaggagacatgtgtccttttgatcatggaagtgatccagtagttgtagaagatgtgaatcttcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggaccaccacctccacttcctcctttgcagccatctggcatggatgctcctccaaactctgcaaccagttctgttcctactgtagtaacaactggcattcatcaccagcctcctcctgctccaccctctctttttactgcagtttttgtattaccagatacatatgacacagatggctacaatcctgaagccccaagcataacaaacacttccagacctatgtatagacacagagtgcatgcacaaaggcccaacttgataggactaacatcaggggatatggatttgccacccagagaaaagcctcccaataaaagcagtatgaggatagtagtggactcagaatcaaggaaaagaaccattggttctggagagcctggagttcctacaaagaagacttggtttgataaaccaaattttaatagaacaaacagcccaggctttcagaagaaggttcaatttggaaatgaaaataccaagcttgaacttagaaaagttcctccagaattaaataatatcagcaaacttaatgaacattttagtcgatttggaaccttggttaacttacaggttgcttataatggtgatcctgaaggtgccctaatccaatttgcaacatacgaagaagcaaagaaagcaatatcaagtacggaagcagtattaaacaatcgctttattaaggtttattggcacagagaaggaagcacccaacagttacaaactacttctccaaagcctttagtccagcagcccattttgcctgttgtgaagcagtcagtcaaagagcggctgggtccagtaccttcaagtactattgaacctgcagaagcccagagtgcctcttcagaccttcctcagaatgtaactaagttatctgtgaaggacaggttgggttttgtatcaaagccatctgtttcagcaactgaaaaggtgttgtctacatctactggcctaacaaaaacagtgtataatccagctgctttgaaggctgcacagaaaaccttacttgtttccacctctgcagttgataataatgaagcacagaaaaaaaaacaggaggcattgaaacttcagcaggatgtaaggaaaaggaaacaagaaattttagaaaagcacattgaaacacagaagatgttaatttcaaaactggagaaaaacaaaacaatgaagtctgaagataaagcagaaataatgaaaactttagaggttttgacaaaaaatattaccaagttgaaagatgaggtcaaagctgcttctcctggacgctgtcttccaaaaagtataaaaaccaagactcagatgcagaaggaattacttgacacagaactggatttatataagaagatgcaggctggagaagaagtcactgaacttaggagaaagtatacagaattacagctggaagctgccaaacgagggattctttcatctggtcggggcagaggaattcattcaagaggtcgaggtgcagttcatggccgaggcagggggcgagggcgagggcgaggtgtgcctggtcatgctgtggtggatcaccgtcccagggcattggagatttctgcatttacggagagcgatagagaagatcttcttcctcattttgcgcaatatggtgaaattgaagattgtcagattgatgattcctcacttcatgcagtaattacattcaagacaagagcagaagctgaagcagctgcagttcatggagctcgtttcaaagggcaagatctaaaactggcatggaataaaccagtaactaatatttcagctgttgaaacagaagaagttgagcctgatgaagaagaatttcaggaagagtctttggtggatgactcattacttcaagatgatgatgaagaagaagaggacaatgaatctcgttcttggagaagatgatttgactgatcattgatctgcatatgctagaactctacctgtgtttcattagtattatctaatgtacttttacatatttgtaaaaacaatttttggtaaaatgtgatgaagatggatttcacaaatagacaaaaaagaagaaaactaccttctgatcttgtattttgaaagattgatgtttgcattttacttcagtaaacaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggactgtgtatgtattttaccatatgggttttaatgataatggtgtatgactgctttacatgagtccttatgcatccagatgttataataaagtggaatggtctctttaaaaaaaaaaaaggaaagaaaagagaaaagcaatgacaaaaaaaaaaaaaaaaaaaaagccaagacaatgttccttgatttaaaaaaaaaaagaaaagaaaaaagaaaagaaaaaaattaaaatagaccattccagatggtgatctacccttccccccaattatcacaaaaggagctataatcactaacttattcttaataataatggttactggtacccttacaataatgtacaatccaatgtttaaaaattataccacttgagtttggtttgatcctataaattttcaacaaatgtcttaaaatttaaaagcaggctgattagtttggaaccagactgcaagtagagctaacatttggtgaataagaaaacatcacattacattttggatgtatgaaagaaaacttgaccatttgaagatatatgaataaagaaatgtactatagatactactttaggaaaacactgtttggtaagtgttccagtctgatattttaagtgtgtacttcctatacttgtataaaaatctttgatgtttgcaacaatactgtgatttttttaagtggatttcttttgcaagtgaacatgatcattgaaagttgatatggcagtttccaggaaataaatgcattctttgtagaatgggggtgggagattacatatttatattttcaaattcatcattttgattgcaagtgtttctgcctctcttgagattatagtgataatattaaaaaatcacatttaaaaaattactttcttccatattggggtcctcacaatcaaaagctgttgttccaccaccaccatagtcttctgccagtggagtaacttaaggatgctgttctttttcttcttccccatacacccctaattggggttgaagttgtgtgtattttcttgatggtaacactatttcatagaaatgctttgccttgcaattcgtgtctacgtttatatttaaaatttcaaaatcagatttcagttgtcaaaatagtgactttgctcaaaaagtcactatttttacttatatatttaaatcaaagatctatttttatgtagtctcttgtatgttgactatgtgctattctgattcattaggtaagtttgttttcttttctttttagtagtcgtgaaag

SEQ ID NO: 177698 - DNA, 6451 bp, Homo sapiens
  Payload ID: 14871
  Gene Symbol: RBM27
  Gene Name: RNA binding motif protein 27
  Uniprot ID: Q9P2N5
  ENST ID: ENST00000265271
  CDS Start-End: 167-3349
gggttagttcctgttaggccccggccgggggagtaggttgaagtctcctaagatgcccggtgggctggggcaccgggagctgtgaagggaacgtgagggggcggcgtagtggagacccacggcaggcctgaagaagagcggcggccgagcccgccttccctgcaccatgctcatagaggatgtggatgccctcaagtcctggctggccaagttactggagccgatatgtgatgctgatccttcagccttagccaactatgttgtagcactggtcaagaaggacaaacctgagaaagaattaaaagccttttgtgctgatcaacttgatgtctttttacaaaaagaaacttcaggttttgtggacaaactatttgaaagtctctatactaagaactaccttccacttttggaaccagtaaagcctgagccaaaaccactagtccaagaaaaagaagaaattaaagaagaggtatttcaggagccagcagaggaagaacgagatggcagaaaaaagaaatatcctagtccccagaagactcgttcagaatctagtgaacgaaggacacgtgagaaaaaaagagaagacgggaaatggagagactatgaccggtactatgagcggaatgaattgtaccgtgagaagtatgactggagaagaggcaggagtaagagtcggagtaagagtcgaggcctgagtcgcagtagaagccgaagtagggggcgcagcaaagaccgggatccaaataggaatgttgagcacagggaaagatcgaagtttaagagtgaaaggaatgacctggagagttcctatgtgcctgtgtctgcaccacctccaaactcttctgagcagtattcctctggggcacagtctattcccagcactgttactgtgatcgcacctgctcaccactctgaaaacacaactgagagttggtctaattactataacaatcatagctcttccaattcttttggtcgaaacctaccaccaaagaggcgatgcagagattatgatgaaagaggattttgtgtacttggtgacctttgtcagtttgatcatggaaatgatcccctagttgttgatgaagttgctctgccaagtatgattcctttcccaccccctcctcctgggcttcctcctccaccacctcctggaatgttaatgcctccaatgccaggtccaggcccaggcccgggcccaggtccaggcccaggcccgggcccaggtccaggtcctggccatagtatgagacttcctgttccccaaggacatggtcagcctccaccatccgttgtgcttcccataccaagaccacctataacacaatcaagcttgataaacagccgtgaccagcctgggacaagtgcagtgcccaatcttgcatcagtgggaacaagactacctcctcctttaccccagaacctcctttacacagtatcagaacgacagcccatgtactctcgtgaacatggtgctgctgcatctgagcgacttcagttggggacaccgcctcctctgttggcagctcgtttggtgccacctcgaaacctcatgggatcctccattggataccatacctcagtctccagccctacccctctggttccagatacatatgaaccagatggttacaacccagaagctcctagtattactagttctggtagatctcagtacagacagttcttttcaagaactcagacacagcgtcccaatctgattggcctaacatctggagatatggatgtaaatccaagagctgctaacattgtgatccagactgaaccaccagttcctgtttcgattaatagcaacataaccagagtagttcttgaaccagatagtcgaaaaagagctatgagtggtttggaagggccactcacaaagaaaccttggctgggaaagcaaggaaataacaatcaaaataaaccagggttcttacgaaagaatcagtatacaaacaccaaattagaagtcaagaaaatccctcaggaattgaacaacattaccaagctcaatgaacacttcagcaaatttggaactattgttaatatccaggttgcttttaagggtgacccagaagcagccctaatccaatatcttaccaatgaggaggccaggaaagccatttctagcacagaagcagttctaaacaaccgattcattcgagtcttgtggcatagggaaaataatgagcaaccgacactacagtcctcagcacagctgctcctgcaacaacagcaaacacttagtcacctctcacagcagcaccatcacctgccacagcatctacatcagcagcaggtgctagtggcccagtctgctccttcaacagtgcacggaggtatccagaagatgatgagcaaaccacagacatcaggtgcatatgttcttaacaaagttcctgttaaacatcgtcttggacatgcaggtggtaaccagagtgatgcatcacatttgttgaatcagtctggtggtgctggagaagattgccagatattttcaactccaggccatccaaaaatgatttacagctcctcaaacttaaagacaccttcaaagctctgttcagggtctaaatctcatgatgttcaagaagtgcttaaaaaaaaacaggaagcaatgaagttacaacaagatatgaggaaaaaaagacaggaagtgttagaaaagcaaatagaatgccaaaagatgttaatatccaagttagaaaaaaacaaaaacatgaaaccagaagaaagagcaaatataatgaagactttgaaagagcttggagagaagatctcacaattaaaagatgaattaaaaacatcttctgcagtctccacaccatctaaagtgaagacaaaaacggaggcccagaaggagttattagatactgaactggacctccacaagaggctgtcctcaggagaagacaccacagaattacggaaaaaactcagtcagttacaggttgaggctgcacggttaggtattttacctgtgggtcgaggaaagaccatgtcctctcaaggtcgaggaagaggccgagggcgtggaggaagaggaaggggctcactaaatcacatggtggtggaccatcgtcccaaagcactaacagttggaggattcattgaggaagaaaaagaagacttgcttcagcatttctcaaccgcaaaccaagggccaaaatttaaagaccgtcggctacagatatcatggcacaagcccaaggtaccatctatatccactgagactgaagaagaagaagtcaaggaggaggaaacagaaacctcagatttgtttttgcctgatgatgacgatgaagatgaagatgaatatgagtctcgctcatggcgaagatgaaatctgatgctagctgtataatttttaggaatattgtttagaagaacaacttttaaaaattatttaaaagaagtcaatgagccaaaaaaaatttttttatttttcttttcaacacagtaggttcaagaacagcaagtttgctatttaaacacatctcataactgtacatgatattaaagcaccaaaggcctagtgacttttacacagttgtgaagatccacagcaatgacatggataatctctagagccttattttccacaccaccttttttttgttgctgttggtgttggattatgatgtaaatgacagggtgttcagaaattttattttggattataatctactgataaaatttaattaaatgtcaaaatcacctgtaatcttttaactctcagttgttatggatgggtcatcagacagtaggaaatatttgtaattaaaatacccttttgctttcaagagtggtcttggaagaaaaatatgtttattttaattttaatttttttttttttttactttggaggagcccaatttgtattcagtctaaatttgtttttcatggtttttatgtgtggtagtactagttcagtgaaaatcacaacaaactgtgtgttcttaaatgctacagcaatggtagctagctctatagtatttccattctcttgtcatatgaactcctggacttttcctgctactgattcttagtttgctttgatatttagtgagcgctggttcggctggtctttttaaaaatttttataactcagaatgtaaaaggctttcacctattgcccctttctcgtcccccttttcttcctcttgcctttctattaataggcctgacttagtcatcattgatataagtggttcatttgggcaaccgcaggcagtctccaataaaaggttcaaaccagcacctggataaataagtgatgttttgatgagaatgatggaaggattttggggagaagagaatcaccagctttattttttccctcttttgaagcttcagttcagtatagttacacagaagggtttaaaaatgtctgaaattcttttcctaaatttaaaccatgatggtgaggtgactggggggtggggggtggaggtgggagggggttgagggctgagtatgctagtaataaatgggagtcatatatgactttgttcagatgaccttattttttcataattttgtagcttgttgctatccatgaacatacgcatccctcagtagacagtttcctttactgtgtgcatttttactgtacactgtatagagtagagtatctgttaagtaaaatatatatgtaaatttatgtcttcgtgttctgaatgttagatggaaaagcagaggagcaacactacactgtactgacccctgggaaaataaaatgattaatgtacctaggctgtcactttttcaaggatatacacatctgtgtttttatatatgtgtggtatgaaaatttgaaacctcctgttgtctccaaaagggtcttggtgaccactatatcaaggattttgtttgctgaggtaaagacaatttctcaatatagaaactattcactaagaacttaaaaccatcaggattctagatttacttagctataagaagttaaatcccacgttctgataatctttattcttctacatgttttcctggaatgatgtgtcaaaccagggtcatttttaagttcatataattttctttcataataatgaggacttcctttttctaggttattgttatatttctagtaacactgaaggtaaaataagcttataaaagaaggaaaacatcagaatggtgtatctagaatacacaatcttgctccttactcctccatcatctctaatgaaatttttcttgatgtctgtggctcagtcagtatatattttgaaagattcattgtggtgaatattttgagtcctgacagtttaaacgtgatagagggaacaaaggatttatatattttttgtacaaagttttttcttaaactgtataattttgtaaataatttgtttgggttttttttttgtgtactaaaactaccagcgtatagatttcaataagaattgttgtatttttgtatttggaaactgaaaattacagtaaataaatggaactctaagaaaaatttcagtagacagttcaacagaatgagattccttttcatatgatttttttgacctcaaaatggacatcttatttcactctcagtaaaaagttgaaaatttgactttttagtattgggggcagaagatagaagtgtgttaaagtgaaaaacagttttttcagtaaggtttgaggccctttctataagttttcagtacaccttaaacaggactaaaaatactttaaaagtgtgctttcaaagaattttaaaacatgtttgactcaaagatgaatttgaagtgagttaattataatactggaaaacttcaggttagcataaaatagtttatatatatcccctgccccctttgggatttacttccaccatcaaatcttcaactgttagaatttcacttaaaagtgaataactgccatacatgttttcttggcatcttcatttacagaaataacatacagcatctaaagcaagttctgtccctcttaatgtgtatgacatctttttaagtagctgatcagcaataatagccaccagttgactaggtcagcctgatatactagtggatcactgtccaagataaaaaggtaaccccaagtattgcaaaatttccctcaatttctttatgtaacattgaagaaatgttgttaccagctaagatgataaattggaaaacagtcttgttaaggtgaaaggggtccttggtgatggatcattatttcaaaaaagaaaaaaatcatgtgaaaaggaatagtggttcctcttgatgtatagtatgcctgtattatagtttttacaaaattgtgaacttgtgtaatagtataataggagatattgttgaatttctaactgtttatacatttaaattcatatatgtaatgtttgttttatcaattacaatctgaatttctaagaagcatgttgacttttgcaataaagatgcaatatggaatggttcacaattgg

SEQ ID NO: 177699 - DNA, 15507 bp, Homo sapiens
  Payload ID: 14872
  Gene Symbol: RBM28
  Gene Name: RNA binding motif protein 28
  Uniprot ID: Q9NW13
  ENST ID: ENST00000223073
  CDS Start-End: 116-2395
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagcattctggagtgctgaatttttaagatgtatattttgttaagcatattctctaaatgagatattgtgtggctttttagtaacaacgtcatttctaatatgtgtgactcctttattatgtatgaacattctttgacattcctaattcagctctgtagtcttacacactgcaggaactgtctaagcgagagcagagagaaatgctttctaacctaatcgctgcaggcggagacacttggaaaagaatggggggaggtggggcctgacagagagcagcacttatgtgtttgtcagatgaggggatttccagttgaattggcctgcagtggcctaaagacactagcctggttagcgatgacctgcatttctctcatagagcacctcccttttcatcgtatccactagctctctaagtcctccttaatgaggacacttgatcctcattaagtctgccccttaagatggcttcacacctactgaaaaactccaggggtttgacatctcactttgattgaaatcttgtcttcctataacatttgattccctgggctcttcagccctatcacctctgcttgtctttatccactctcttcttcattcacttttggctacacaggccttccttccatctcttgactcttgaccacctcagagcctttgtatccgttccctttgcctggagagtttttcccttgcatcttttacttgtcactcagatctccactagttgtcgcctcctcctggagctcttcccagactatctaaagtagggcttttcttcccctcccctctatcttgcccccttactgaaatctgcttccctgtttcttcttcttttttttttttttttgagatggagtctcactctgtcgcccaggctggagtgcaatggcgctgtctcagctcattgcaacctccacctcccgggttcaagcgactttcccgcctcaccctcccaagtagctgggactacaggtgcacgccaccattcttggctaaattttgtatttttagtagagatggggtttcaccatgttgactaggctggtcttgaactcctgacctcaggtgatccgcccacctcgacctcccaaagtcctggtattacaggcgtgagccaccacgcctggcctgcttccctgtttctttctagcactaatctctatctgaaatcatttgtctctttctagcactaatctctatctgaaattgtttgtctctccagttagaatgtatgctttgtgagagggactttatccctcttgttcactcctgtagacacagcacctagtactgacccaggcacgtagtaagtattgaataaatatttgttgaatgaaaaaaataaggtaggaaaggaagaaacagtattcagtaggcaagagaaaaagttgagaacgtggcccaaaattcttgattgcttagtctagttgagtgttacaaataatgctttgacagaaccattgctgagctagagatatggttatttcttttttttttttttttttgagacagtcttgctctgttgcccaggctggagtgcaatggcatgatcttggctcactgcaacctccgcctcctgggttcaagcgattctcctgcctcagcctcccgagtagcggggattacaggtgctgccaccacgcccggctaatttttgtatttttagtagagacgggttttcaccatgttggccaggctgatctcaaactcctgaccttgtgatctgcccacctcagcctcctgaagtgctgggattacaggcatgagcctggttgagacatggttatttcatcgcaatatcttggggaacccatgaatgctctgaaatgcctttggtttagaaatggatgaaggagaggccatggaaatatttagaccttttggagagatcgaaaggacaggtgatttatctccaagttcacctcgagacatgacttgggctgtcaaatgttcttacggtagcctggcaacatgtctttctcagcctggtctgtacagtgtggaggaagtaagggactttattaagagtgtcacaatagctataacctgccagtcaggtgatctgtttttccttggccatctctccgtctgctcaccactcttttttccctagtacacgaatatctttaacattcaaaaatatatcttaacacttaggatagatcaaaattggtgttcattcagataacattgtcagattctcttagatccaaatatttcttttaacaacttaacagtatgttaaaacctcattcacttgcttggagagctgttgtacagttctttaaagagttctttatatgaggttgaatcttccctttcttaatagtcaaattctatatatggtgtcttcctttggaacaccttaccatgggctatttggtcagctccattgactccttgccttgggaattttagtgcagtgagagttgtgctcacttctccttcacttcagggcctgatgtgtcaggaaatggagttttctgaattaacatgaaagttgagttgcagattgcttggttaaaaaacaacaggtggggcacagagtctcatacctatgattgcagcacttcgggaggtgggaggattgcttgaggtcaggagtttgagaccgacctggccaacatagtgagacccccatctctattattttgaaaaacaacagcaaattttttcttaacatccaagacaaggccaccagtcaaaactatcaagttttagtagtattttcctgcttgattatataatagcctggcttagagatacaacctttaaataaggaatcttaagatgatgtgcagctgttctttgccttatttgtttgtttgttggttagtttgtagtttctaagaatctgctctgttcagctgtacagttccttcttctggagttaacctgtggcaaggattatgtttcacctgtcacaaaaatgagatctgtgccttcctctattataaagttagggcatgtgattcattcttcgaaatacttcaaaatgtactttggtatgtttttgtcttgaaaagaggttttctagctagaaattcggggcccagaaggtcaaggctccagagatccccttctcatcatccttcagttgtctgaggagacagaggatcacatgtgtcacagtgagtgctgattccccagaatctgcagtcttaagctcccctgctgacgcacacagccagttctctgcttcatattcatgtgacccactgtgaagtgacaggcagctgccaattctgtcatataagaagcagctctgcccatgcaactttgaaagttcctgcacttctccatagactgctccttcatggaaataaacacatcatcacactgtgggtgcctaagctaagtttgtttgcagtttgatgatgcccagctccttttcaactcagccttaattggcactttaagggccaggatgaggtttctctcaggccaagtcgagatttccagatttccttttgtccaaggctgaccagtttagaagttattcacatccttgttttagttctttccttcttgtcctggtacctcttcctttccaggattatttgcagagtctgtgatggcttacttggtgaccagacatggggtgagctactggtatagtctgattactttggcatctattctgaactggtcattggctgtacatgagtttttgtgctggtaaaggaatatactgggaagattggaaggcacagactgggaactaattctgagaagagaactgctgagttactgaaagaccttttggaccacccctaaatggagcatcttgatagatggcaaatccagtgtttcttaaacttgtccatgctgcccagagcccactgccttttatcagatgtgagacttcactgccacagtgtcatcccacagtttccttccctggacatttgataaagggaaaatcatttcttgtcctttaaggcagggactattattttttcacttttccacataccccacaacacctaacattgatttactcgtagtaggagtttcatactgttgaactctctaaaggccatttgttccagggcctagctgggcttgtgaaggacaacagagtcatttcctaaggaccccaaaagacagcatgaaggaaaaaataataataaactgctgttcacagtgccttgagtgtaccaccgtactttctgctatgccttgtccattccaatctggacagtctctgtgcccctcctttccactcaagtgttatccagcactcaagttctggctcaaggcccaacatctccgtggggacctcagccatcccagggcattgtgaccccttcctctaagtccccggcacactcgctgattggtaccctctcattcgacaaagcatatgccattgtggcttacttgtcatttctttaggtcttgccttcccaagtagatcatgagccactataagaactagctcccatagtcccagcccctgggcctggtacatggcaatgcttagtgattggtgattgaggataatggtggtaaaggatgtaccagacagtcatctcctgaagagatgccgaacaacctgtccttgttttatgtattttctctttctttcctgtccagttttattcctctcatagtaactgctaaaaaaatatcagttcctgtcactcttccaccccttttctccctctcccctgcattgtggtctgggccttggtccactagcaactccccttaggtgttgcttaatctgcctcatggccaaagccaatcccattcctgtcccccgctacccaagggactcccagtctgtatgcacaaggcgggatgtgaagtctggatgtgcaagaaacccagctgtaagaaacagcttccctcggcttggcatggtggctcatgcctatattcccagcactttgagaggtcaaagtgggagaatcacttgagcccaggagttcaggactagcctgggcaacatagcaagatcccacctctacaaaaaaagaaaaaattcagagtctcaaatgtcccttcatctccttactctcgacctgtctccctagttctctgccgccttttcctctcccctggatctgacactcaattgtctgcatgcacttttcaactgaaagagactccaatgccatccttctgatgaaatttttgctttggatactactgcagaaaaaatgctatcttgtattctggtccatggtggggaagaccctgtcgtagaacctggcaactcaagtggagggaggggccagaacattgttcttatgctatttacagtgagacaacaggattgatgcagaactttctttttttttttttttttttgagacagagtttcattcttgttgcccagggctggagtgcagtggcatgatctcagctcactgcaacctccaccccccaggttcaagcagttcttcctcagcctccggagtagctgggattacaggcgtgcgccaccacgccccactaatttttgtatttttggtagagacggggtttcaccagtgttggccaggctggtctcgaactcctgacctcaggtgatccacccacctcggcctcccaaagtgctgggattacaggcatgaaccaccgtgcccggccgtgatgcgcaactttctaataacatacttttgaaagtgcccagacatacatccctcctctggtaccacagtggccatcagttgccagagaacatgaaattatccagccctcagctctgcagcaggattctgaggagtaaagcaggcctgtaaagtactctaaagtacttcagagaggtaatgccacaaagcgaagaacacctcttggaggcagagcccctcagccctatccaggccagcagtgtccacttgaaatctgaaagcagcctccctcaccaaaccagcaagatggaaaacctccctgggttggcaagtggccctgggaagtacatgccccatctctgtcaggatagcagtggagaggtttcgtgccagtgccagctccacccacccagatggtactcaagactccaagcctgtcaatggggtggaaactttctggcattttctgtcagaagggtgagttagcactgaaccatctcatgtgtcttttcactgagtaacagcccatatccattccatgaaatgagtgactgctttgttgaatcagatagtaacaaacatttatttgtagtctggttgtgtcatatcatggttgaattgcaaacaggttggatagaagagtcagcaaaaatcaacaaaagcattctgtaaaaaacttttctagaattacaataaatggcattgtatattttatttataaattatgtgctgcacatcatttttatcaatgaaatttataataaatttctgtacatatatacatttttatcccagagagccagttgttaagcatttaccagcaataaatgctttttgtttcctgcttacacaggttctgggagtggccagcccactctttgagatgtccccacttgcttttttagttgtccaagtagtgttctgcccagccttcccgactctctttcttatccttccctcgaaactattctgttccttatgcttaaatactttccagtcatgggagctttgctgtaggcccttggcctttcatgggtagcttctgatacgtgcatgggtgttaatagaggaagttgaccccgcctgggaagaataatgacctatggagacctggccctttctcttatggcttcttaaagtgacagctgttatgggaagttcaggcatcttgacgtggaaaatacattgttcattttcttttaattttttttcccctaaccactataccaacagggatggaaagatacttttagttggaaggaatttggagcccttaaacgacacctggagcagctgcctgtgggtggggctttgcacagtctcatcctggcaagggaggacgagccaaggaccagttttgcagaattgtcatcatgaggccctggttgtgtgctgggctggggcattgcccctttccaggaggccaggccaagcagggctgcctggcttaggcttttgcatcttcagcatcctttcacgtctcttatctcaggtgaccttcacagcaagcctggtgaaggttattgagaagcagatgtcaccacctagtcttagagctgatgaaagcaggatgtggggaagtccagaccctctcctgaaaccccttggccacctgagctagtaccagagcaaggtcccacttggccgtgagtgctgtctctagggcctatttcaggaactgtctcatatataagaacagaacactttttgccagctataccaaatgtttttgggattaaaaaaatagtttctcttttccaaattaggtggtaagaaaaggaagggcattttcattctcacattctttgaatgttgaaacgttttaaaaacttccagctgggcttggtggctcatacctgtaaccccagcactatgggaggctgagatgggaggatcccttgaggccaggagttcaggaccagcctgggcaacatagtaaaactgcccaaaatttgaaaattagccttgtgtggtggtgtgcactgtagtcccagctgctcgggaggctggggcaggaggattgcttgagcccaggagtttgaggctgcagtgagctatggttgtaccactgtactccaacctgggcaacagcgtgataccctgtctaaaaaaataataaaaataaaaaaggattaaaccctttacttgaccagcttcttttcctgctacccctggactaactaatcattacatatttttgtagttgttttttctttctttctctctcctgatctaccacaagccaaatgtactcatatacatactaataggtgaaaaaagagagtctgaggagtgaatacatttattttgtgatttcctaggcagtagctaggactcccttagaggttgctaatagggaaagggtgcgctggctctactcagttttataactgcttttccccgaattctgcagacatcttcattcccctggaggtcagataatggctatttattttccatagccatgaaaatctctggggagagctgtggcaatttgacgagagctattaaagggacattaggattgaagtagctgctcaggcagtcacataccctcgatcctcatctgcagggacagctgccagaacgaatgagcccagctctcctgcccgcagccagccgcgtgtgggtgcaactggcgaccagccactggagtgagtcccagggaaggggacaggttcttagaatcaccatttgtctctgctctctccctctctgcaataggacgggcactctaaactcacataatggttaataacaacagctaacaattactgagcacctactatgtgtcaggcatgtgctgaggatgatcgcatcaagtaaaatgcctgtctctggcccagaggcccagaagaagagaaagaagggaaatctgtaggaggcaaacagtcccttacccctctgcttgcagaccttcagtgacaggacactccctgtttgctccaagcacctcttgcattttcagagcttgggacacagattcagggacttgcacttcgatagagtgcctcaggacccctcgtcggagccatggaaagtcagtttctgggcccatccttcctgtgggggtgtctttccttctcttggccaccccctaggaatccctagtagagagcaggcacttaatagccagtgcagtgagagtggtctgtgatgtctgggccagggcaaggcccgccaagtgggctcccaggtgcctgccacagagcctctggggtttgaggccctcagtgacccttaggcaatagctgggtcttaatgagggatcatgtcctttcctgggtagtcgtgggtagaggggtgtgaactgatctgagctactctaggaaggctagagacaaaagcaggaaccaagagaagggctgaggctccttccaagagactccaagtcctgagggcaagaagcggagagccttgtgccaggccaggtgttgcccctgtcagtgctgacggacaggcaagagaggctgctgatgctgcagccctgtgaagctgagactcaccctttgcccactttcacagccatctccccaggaggctgtggtgacacaggtaaaagccaaaggacagaggatgaccctggacaaatcactcagaccctccagtcctctttgctcatttataaaatacaggcaaaaagccccctagtactaaatgaaatagccactgtaaaagagcacgggagatagggtctgtgatgtcttttgtccccagtgtcctgagtgaattcacaggaaaggggagaaagactggttgcccacttccagggtgattggctaatttccacttctttcctgctagggatgggaacacacgccagaatcctgggaaggctacatgtcctcaggtggtgctggccccacctccagcctctgcagggataccaggatatgagccaggctctgctcccggggtgacccatcctcctcagtgccccttctttcctcacaactgcaggcagaaggagagtgtgtcctgtctctctgaggagctggctgtgccatttaagcaggccctaggggtggagcgctgtgaagagatggcacccaggtccctgttcctccttttccagagcaaacactgctaagggatcatgacagtccctgcatctggcccagactgggccttgggaggcttttgacatcaatccatgcaaccgcacccaacaattggagtcagcatgggaggtgagacccacttgccaattttgctctcagggaacagccctctttactaaaacatagcacagtattgataacagttgtttccaggcatcgtagaaagcgtttagtgggcattaacgtctttgatcctcaccacaaggtcaggggttggatgatgttagcatgctcattgaaggatcagaaaagtcaggctcaagatagctcgcccttcattcagccagccggtgttaactgaatattaactgtgcacccgtctgtgccagtgttcccccaggagctgcagagggtcctgagcagagtgagctcaagccacttgggagctcacattccagctatcagtgctgattcatctcaaatgtttgatccacgctgggttctaacccttccctgctcagagccctcagagtccaggtcaggtagaacccagaacagagcctctggcaggaaggagcttgcatggtcctcaggcttcatgtccagagatcattcctccactttgagcttctttgtgaaaaccaatcacaaagagaggaggggtgaaatgtgccaaagcctctgccagggttgtagcaaggaaacctgggcttctagggaaagttgagaaagggcctatattagtcaggagggctactgtaagagagtaccacaggctgggtggcttaaacaacagaaatttatcaccttacggttctggaggctagaagtctaaaatcaaagtgttggcaaggttggttccttcatgaggaatttcttggcgttgcctggcatatagatgcatcactgcagtctctgcctcgttgtcacatggccatcttctccctgtgtctataggtctatgtccaaatttccctcttcttataaagacaccagtcatattggcttaggcccagcccaatgatttcatcttaatttgattacatctctgctatggtttgaatgtgtcccttccaaaattcaggttattgccaatgtgatagtattgagatggggtccttaaagaagtaattaggccatgagggtgcctctctctgaagggaggctcattggattgtatcagtgtaacataatttacataaccagttctttatgtgatggaaatcccattcaacggtttccaacctttgctattacaaactgctgtgaagagaaacatatgtcattatactaatcaggtgctgttgttgtttttataatgcattatcctggagagactgcccctcccagggctagctactttggggagagagtaaacaacttggtcgagcgtgcctttcgtatgcaaaccagtcaatccagagcccacacccccagtcacctcctttatcaaactctgacacagcaagccaatattccccctgccctaaatcactccagggccaggcatgggacaactagggacaatccctatagccagggcctgccaaagttatacagattagccaatcctaagcctgcttccctgccttgccttgcctttctgctggaaactacattaaaggcgctggatcgtgcttttccctcaccccctctgcttcttggctgacccaagttcttcctgtgtggccctgcaaggcgtgacacacctctcctcctgggaactgcataacaaactcttcttgcagagatagttttctctgtgtctgtcatcttaccatacctgatgaaaacaaatatgggtacatttttttttttttttgagagagagggtctcactctgtctcccaggctggagtgcagtggtgtaatcacaggtcactgcagcctcgacctcctgggctctagtgatcctcccacgtcagccttgcaaatagctgagactacaggcacacaccaccatgcctagctaatttttggtgtatttgttatagagacagagtttcgctatgttgcccaggctggtctcaaactcctgagctcaagtgatccacccaccttagcctctcaaagtgctgggattataagtgtgagccacagcatccagccatgggtacattttaaagcaggcgttttgttcatgtgcagcccttgttctcagttaaggggaaaatgagtgatcctttgcttggctctgaaggagcagtgttttatatgtaaagaatatattctgtatatttaaagaagagcaatggggggcatttgaaaataaatccgttcatttttttctgattgtaaaaataatatatgctcagtaaagagaatctgaaaaatacagaagtattgggggaacccacccccaatatttcaacataggttctttctattttccataagtgtcggccgactgagaaataaagagaaatagtacaaagagaggaattttaacagctgggctgccgggggtgacgtcgcatatcagtaggactgtgatgcccacctgagcctcaaaccagcaagttttttattaagggtttcaaaaggggagggggtgtaaaacagggagtaggtacaaagatcacatgcttcaaagggcaaaagcagaacaaagatcacatgcttctgaggaaacaagacaaaaggcaaaacagaactactgataagggtctatgttcaactgtgcgcgtattgtcttttttttttattatttaagttttagggtacatgtgcacactgtgcaggttagttacatatgtatacatgtgacatgctggtcgctgcacccactaactcgtcatctagcattaggtatatctcccaatgctatccctcccccctccccccacccctcaatagtccccagagtgtgatgttccccttcctgtgtccatgtgttctcattgttcaattcccacctatgagtgagaatatgcggtgtttggttttttgttcttgcgatagtttactgagaatgatgattttcaatttcatccgtgtccctacaaaggacatgaactcatcattttttatggctgcatatgtgtatatgtgccacattttcttaatccagtctatcattgttggacatttgggttggttccaagtctttgctattgtgaatagtgccgcaataaacatacgtgtgtgtgtgt

SEQ ID NO: 177700 - DNA, 2251 bp, Homo sapiens
  Payload ID: 14872
  Gene Symbol: RBM28
  Gene Name: RNA binding motif protein 28
  Uniprot ID: Q9NW13
  ENST ID: ENST00000415472
  CDS Start-End: 78-1934
accaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcagaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaatttttattctttatttctcaaatggaaacacctgaaaaagc

SEQ ID NO: 177701 - DNA, 932 bp, Homo sapiens
  Payload ID: 14872
  Gene Symbol: RBM28
  Gene Name: RNA binding motif protein 28
  ENST ID: ENST00000478061
  CDS Start-End: 82-932
tcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataa

SEQ ID NO: 177702 - DNA, 715 bp, Homo sapiens
  Payload ID: 14872
  Gene Symbol: RBM28
  Gene Name: RNA binding motif protein 28
  ENST ID: ENST00000487602
  CDS Start-End: 1-560
ataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtg

SEQ ID NO: 177703 - DNA, 728 bp, Homo sapiens
  Payload ID: 14872
  Gene Symbol: RBM28
  Gene Name: RNA binding motif protein 28
  ENST ID: ENST00000459726
  CDS Start-End: 116-728
acttccggaatctctcggcgtgtgagcttggttgtcctaccaaagccagcgtttcggctcgcgtgcgccggcctagtttgctcgcgtcctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagtttatgtagatcagtgtcctgtgtcaaagggcttataccctgaaggagattcaaatgcagtggaaagagaagcagagcatatgaactatgtgtccttttcagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctc

SEQ ID NO: 177704 - DNA, 1404 bp, Homo sapiens
  Payload ID: 14873
  Gene Symbol: RBM33
  Gene Name: RNA binding motif protein 33
  Uniprot ID: Q96EV2
  ENST ID: ENST00000287912
  CDS Start-End: 427-1233
cccggaatcgacctatggccagcagtcgtccccgccctgcttcaaacatttgggtttcaggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcctgcagccccctcccttctctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttgggtaacttttttgcctgtctcccatcctcctttactctcatttcaacttcctccatagtattgctgtaattaatcaaagtaggcaaagaaggttgactaggtaattgcggctgccgtccggagagtggccggactttggagtgagtgctgtttatggtactgtaaaactcattctttaaaatcattgctgtttatggatttaaaatgcttgaataaaatgtttaagataattaaaaaaaa

SEQ ID NO: 177705 - DNA, 4360 bp, Homo sapiens
  Payload ID: 14873
  Gene Symbol: RBM33
  Gene Name: RNA binding motif protein 33
  ENST ID: ENST00000307403
  CDS Start-End: 1-855
gatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttggagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtgatacttccagaggaggaattaatgagcgacctgatgccctaagatgacataagctgttggaccttgctacctaaagcctctagagagccccaggctccccctccaccgccaccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctgttcaagtgcccttgctaccagttccgagccagccgagacctgccgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggtaatgcatcctgagtgaacctccagggaaaaaatgtgtagcttcaaggctttgtgttccataaagtttcagatttttatttgagcctactaatttgtggttatttaaagaatagagtattagtctcaaatgtactgtttgttaaagacaacttttttcaacaatgttacttatctcaatacaagaaaaaaatgggaaaatgtcattttttgggaattgaaaaatgctacttattataattgtttaaagggtatactactaataaaattaggacatgttttgataatacatttgctcatctgtataaaatttcatgagaggtttaccagtggaaatactttgtcaaattatattcctgcagtagacagttttgaaaagagtctttgcatggagggaagaagatgttgctgttcactggttatttgaaggccttgagtgccctctgccgaccggcttctgcttcatgggttttcactggttatttgaaggccttgagtgccctctgcccatcggcttctgcttcatgggttgacatgcgtctgtaacatctttcttaccaagtgtatatttcttcttgtattgtagggttactattaaaatacatagcgatggtaaacttgaatcaactatttaaaaatacgtggaatacgtatctaagccaaaaacggaaaatgaatattatctagggtgttaaaggaagataaaatgtttttaagaatttttctttttattaaaaaaatgcaattaatacatccccattgcagaaattttcaagtatatataagaaaggaaattaaatactctcgttacctagaaacaattcaggagcttttttttttgtctttttttaaatgcacatcttctcgccacctgctttttccctccagtgtcacatatcatttgatcttttcatgtcagcgagttggttttgatgccatcgtttgagagtgctgtatgcggttccctttcatgctgtctgtgtggttgcatgtgtgtatactggtttcagtactttagtatcatagtgctacagggaacatgctttagagttatgagtttgtctgcatacctagttttccttaggacaattcaatcctagaattactggattaaatataaaatttaaggtaatagcttctggcttattactgcattttagatagtattaccttcatcagcaagtctaaaatgaagttttggtatcgctgaaagttcctttcttgtgttgaggttttttaggaaatgattgaagtgattatgcccggtgtaaccatttatgaactgttgtttctctttctttggaaatggaaggggccgttgcatcctccattgccccctccgcatcagcctcagcctcagcaacctcagcaacagcccccgccacagcaccagcctccgcaccagcccccgcaccagcccccgccccagcaccagcccccaccccagcacccaccacagcacccgccgcagcaccagcaccaccaccaccaccaccacctgtccgtcccgccccctcctttgatgccgatgtctcagccacagttccggcctcacgtacagaccgctcagcctcaggccagcagcagccggatgcagtgcccccagcgccaggggctccggcataatacaacttctcagaatgtaagcaagcggcccatgcagcaaatgcagcccactgcgccaaggaacagcaatttgcgtgaattacccatagcgccgtcacacgtgatagaaatgagcagcagccgctgctctgccacgccctcagcacaagtgaaacctatcgtcagcgcgtcaccaccctcgcgggccgtggcgggttccagaagctcacagggaaagacggaagtgaaagtcaagccagctagccctgtggctcaacctaaagaagaggcaaaaacagaaacagagtttcctgatgaagatgaggaaacaaggttatatcgcttaaagatagaagaacagaaacgcctaagagaagaaatcctgaaacagaaggagttacggcggcagcagcaggctggtgccaggaagaaggagctgctggagagactcgcgcagcaacagcagcagctgtacgctcccccacccccagcagagcaggaagagcaggcactgtcaccatcacccaccaacggtaacccactgttgccctttccaggtgcacaggtcagacaaaatgtgaagaacagacttcttgttaaaaaccaggatgtcagtatttcaaacgttcagcccaaaacatccaattttgtaccatccagtgccaacatgcagtatcaaggacaacagatgaaagcactgaaacatttgagacagaccagaacagttcctcaaagtcagactcagccgctgcataaagtgctcccgatcaaacctgcagatgtggaggagccagctgtcccccagactcctcgagtggcgtccatccagggccggccccaggacacaaagcctggcgtgaaaaggactgtcacgcacaggacaaacagtggtggtggagacgggccccacatcagctccaaggtcagggtgattaagctgtcaggtggggtaagttgacaagttttatgagagcctctttgagtctgtgtatcacatagaatgtcctcatttgcagagaatgtttttgaagaaagaattaaaagttacctctgttatagtcttgtaa

SEQ ID NO: 177706 - DNA, 7058 bp, Homo sapiens
  Payload ID: 14873
  Gene Symbol: RBM33
  Gene Name: RNA binding motif protein 33
  ENST ID: ENST00000341148
  CDS Start-End: 294-614
attgcagaagattcttccataaagaagtgatctgtagaacacttgcttctttatcccaccatatagtcttattagttgtgggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcagagtttacagatgcttcctcagcaacggaaagccatagctaagttcaaggagccagcccacgcattagcatttcagcagaaattccacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccactctg

SEQ ID NO: 177707 - DNA, 552 bp, Homo sapiens
  Payload ID: 14873
  Gene Symbol: RBM33
  Gene Name: RNA binding motif protein 33
  ENST ID: ENST00000392755
  CDS Start-End: 1-253
gtgcaagccccagccctgcgtggtgtctgtggaggggctgtcctcgtccaccacggatgcccagctgaagagcctgctgatgtcagtgggacccattcagagtttacagatgcttcctcagcaacggaaagccatagctaagttcaaggagccagcccacgcattagcatttcagcagaaattccacagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagt

SEQ ID NO: 177708 - DNA, 1580 bp, Homo sapiens
  Payload ID: 14873
  Gene Symbol: RBM33
  Gene Name: RNA binding motif protein 33
  ENST ID: ENST00000392759
  CDS Start-End: 176-1102
cttcctgcggaggcgaagggccagctgtggaccgcgaagcgcccggcttcgcctctgcctcctgcagccccctcccttctctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacagatgaagaatacttgcaggcttatggtgggcaacaagggctgcaagagcaggaagactgtgtggctgaagatgaattagatgagattactgatgcccaggttgctcctgcaactgaagagggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttgggtaacttttttgcctgtctcccatcctcctttactctcatttcaacttcctccatagtattgctgtaattaatcaaagtaggcaaagaaggttgactaggtaattgcggctgccgtccggagagtggccggactttggagtgagtgctgtttatggtactgtaaaactcattctttaaaatcattgctgtttatggatttaaaatgcttgaataaaatgtttaagataattaaaaaaaatttttttttgagtctgtggcctacagctgctcttgtacatgctgtggttcctggctggtcttgaaaaggtggcatggggatggtagctatggggccaggttgacccttcccaagaccctgaggttgtcagggcgaattctggacaagaccggtttatattttgtaccttttagtgtcttcatagctatatctttttttgtgttttctgcagttcctctgactttaatgagacaagttgactcgtttatagaaataatcactctgagcaaagcttgctgtgtgaaaggtctactacagactgctgctg

SEQ ID NO: 177709 - DNA, 2934 bp, Homo sapiens
  Payload ID: 14873
  Gene Symbol: RBM33
  Gene Name: RNA binding motif protein 33
  ENST ID: ENST00000392761
  CDS Start-End: 1-2729
ttattaggctctcagatgtaactagagagagaaggaacattccagaaactttggagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtgccccaggctccccctccaccgccaccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctgttcaagtgcccttgctaccagttccgagccagccgagacctgccgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggggccgttgcatcctccattgccccctccgcatcagcctcagcctcagcaacctcagcaacagcccccgccacagcaccagcctccgcaccagcccccgcaccagcccccgccccagcaccagcccccaccccagcacccaccacagcacccgccgcagcaccagcaccaccaccaccaccaccacctgtccgtcccgccccctcctttgatgccgatgtctcagccacagttccggcctcacgtacagaccgctcagcctcaggccagcagcagccggatgcagtgcccccagcgccaggggctccggcataatacaacttctcagaatgtaagcaagcggcccatgcagcaaatgcagcccactgcgccaaggaacagcaatttgcgtgaattacccatagcgccgtcacacgtgatagaaatgagcagcagccgctgctctgccacgccctcagcacaagtgaaacctatcgtcagcgcgtcaccaccctcgcgggccgtggcgggttccagaagctcacagggaaagacggaagtgaaagtcaagccagctagccctgtggctcaacctaaagaagaggcaaaaacagaaacagagtttcctgatgaagatgaggaaacaaggttatatcgcttaaagatagaagaacagaaacgcctaagagaagaaatcctgaaacagaaggagttacggcggcagcagcaggctggtgccaggaagaaggagctgctggagagactcgcgcagcaacagcagcagctgtacgctcccccacccccagcagagcaggaagagcaggcactgtcaccatcacccaccaacggtaacccactgttgccctttccaggtgcacaggtcagacaaaatgtgaagaacagacttcttgttaaaaaccaggatgtcagtatttcaaacgttcagcccaaaacatccaattttgtaccatccagtgccaacatgcagtatcaaggacaacagatgaaagcactgaaacatttgagacagaccagaacagttcctcaaagtcagactcagccgctgcataaagtgctcccgatcaaacctgcagatgtggaggagccagctgtcccccagactcctcgagtggcgtccatccagggccggccccaggacacaaagcctggcgtgaaaaggactgtcacgcacaggacaaacagtggtggtggagacgggccccacatcagctccaaggtcagggtgattaagctgtcaggtgggcagggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcaggtagccgcctgggggtggcatctgtgccacgggtagttgtgtcccaagacaaaatcatttcttgatttaaaacacagtgccctttgtgttggctacttcatattaaaataatacttgggaagtaagacaaataacctgttgtgcatacttagtatcagaacatttgcctcaaacgtttattttgaaattttcagattcttagttataaattttaagaaataaataccccagctgaacagat

SEQ ID NO: 177710 - DNA, 10149 bp, Homo sapiens
  Payload ID: 14873
  Gene Symbol: RBM33
  Gene Name: RNA binding motif protein 33
  Uniprot ID: Q96EV2
  ENST ID: ENST00000401878
  CDS Start-End: 199-3711
atgttgcggtagtttgttgttttcttcctgcggaggcgaagggccagctgtggaccgcgaagcgcccggcttcgcctctgcctcctgcagccccctcccttctctgtcctccgtcacccgtacccgggcccggaccaggcacgtcggcccaccagctggcttggtgggggaggctgaaggccgggccccgcgagtgccatggcggccgccctgggagcgagcggaggagcaggcgccggagatgatgactttgaccagtttgataagcctggcgcggaacggtcgtggagaagaagagctgctgatgaggactgggacagtgaacttgaagatgatttacttggagaagatttgctatctggcaaaaagaatcagtcggatttgtcagatgaagagctaaatgatgatcttttgcagagtgataatgaagatgaagaaaatttcagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttggagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtgccccaggctccccctccaccgccaccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctgttcaagtgcccttgctaccagttccgagccagccgagacctgccgtgggaccccagagattcccaggccctccagaatttccacagcatacacctggacctgttcccaacagtttcagccagcccccacgactccctctccaggaccagtggagagccccacccccgcctcaggatcgagaccctttcttcttaggagtttcaggtgaaccaagattcccgagccatctttttctggaacagcgaagtccccctccaccaccaccgcctcctacccttcttaacagtagccatcctgttcctactcagagtcctctaccattcactcagccaggaccagcatttaatcagcaaggacagcagccagtgttcccaagagagcggcccgtacgaccagccttgcagcctccaggtccggtggggattctgcactttagccagcctgggtcggcaaccacacggcccttcattcctcctagacagccgttcctgccaggcccaggacagccgtttctgcccacacacacacagcccaacctgcaggggccgttgcatcctccattgccccctccgcatcagcctcagcctcagcaacctcagcaacagcccccgccacagcaccagcctccgcaccagcccccgcaccagcccccgccccagcaccagcccccaccccagcacccaccacagcacccgccgcagcaccagcaccaccaccaccaccaccacctgtccgtcccgccccctcctttgatgccgatgtctcagccacagttccggcctcacgtacagaccgctcagcctcaggccagcagcagccggatgcagtgcccccagcgccaggggctccggcataatacaacttctcagaatgtaagcaagcggcccatgcagcaaatgcagcccactgcgccaaggaacagcaatttgcgtgaattacccatagcgccgtcacacgtgatagaaatgagcagcagccgctgctctgccacgccctcagcacaagtgaaacctatcgtcagcgcgtcaccaccctcgcgggccgtggcgggttccagaagctcacagggaaagacggaagtgaaagtcaagccagctagccctgtggctcaacctaaagaagaggcaaaaacagaaacagagtttcctgatgaagatgaggaaacaaggttatatcgcttaaagatagaagaacagaaacgcctaagagaagaaatcctgaaacagaaggagttacggcggcagcagcaggctggtgccaggaagaaggagctgctggagagactcgcgcagcaacagcagcagctgtacgctcccccacccccagcagagcaggaagagcaggcactgtcaccatcacccaccaacggtaacccactgttgccctttccaggtgcacaggtcagacaaaatgtgaagaacagacttcttgttaaaaaccaggatgtcagtatttcaaacgttcagcccaaaacatccaattttgtaccatccagtgccaacatgcagtatcaaggacaacagatgaaagcactgaaacatttgagacagaccagaacagttcctcaaagtcagactcagccgctgcataaagtgctcccgatcaaacctgcagatgtggaggagccagctgtcccccagactcctcgagtggcgtccatccagggccggccccaggacacaaagcctggcgtgaaaaggactgtcacgcacaggacaaacagtggtggtggagacgggccccacatcagctccaaggtcagggtgattaagctgtcaggtgggggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggagtgcaagccccagccctgcgtggtgtctgtggaggggctgtcctcgtccaccacggatgcccagctgaagagcctgctgatgtcagtgggacccattcagagtttacagatgcttcctcagcaacggaaagccatagctaagttcaaggagccagcccacgcattagcatttcagcagaaattccacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggtggaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggcagtgggaaggcctaccgacttactttatcattgagggcttactgatacaatgaaatgagtttcatgactttttttttttttaaacactttttgaaatagagtgtgctgtgtttaaaaccaaaaatatgcatgttgtctctgaaaagtaggcattgaaacagacttttttgtagtcagtgttaataaaacggatcctgtttgggccttcattgttaaggtggacttcatggccactggaaggtctgttttggtgttacctgagtgtgacacaggccctggggtgtgcgtgtttctctaactgtctacacgtgcacataggcagactttctcatagaatgttcttgaaaggtgattggcaaagtcatgcaggcccgccttaaagcgctgattagaacagtccaacacagtccgacctcactcaatacccacaaccatcgaaaatggattcttagtaccagacaatcccagtaatgaaggtttagtttccttgaaggaaactacagaaaaggaaagaagcagaatgagaaaggaatggtacttaggtgtttggtatgctgctcacgtgaagtcagcccacaccagccaaaccctcgtggaagatctgctgcaaccattatctttgttcttgagttcatcatgcatttaaaatgagatgcaagagcatttagcataccatgtaaatatggaccttttaaaattaaaatactattggaagtgctttcaactcagccacatcttagctattagttctttgtgttgtcttatcaaagtttaatggatacagttccacagttgttgatgtgtttgtgtgtatattcgatttttataaagatggtagtaagtcaatacatttatcctgatctgtgtattatttgttcacaaattcaagaagcttaaaggtcgtaaatatcagtatctcataaggtaaaccaatagctgattatgtggagccaagttacttcttttctttttgcattatcttgttttggttttgtgctgtaatagaagttcacttagctactttagataaccttgcattaccactggtctggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctccctacttgtaggcctcagctatggcttgacgtaatcgcttttagacccaggttggcttcccttcattaagctatgatcctccaccccattttttttttttttaatttggagtgggagggaggggggtgggcgagagaaagctcgaaaggtattattggtttttcaaaaaattagaggtgacgattctaccagggagttgactgataggagtgtgtgcagggcaggaaaggttcggaggcacccgactaccaccactcggaaagccgctagtccagatcgactagggagaggcttagatactttagtgtatttaaagagcatttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtagctcctgtcccattccaagactcactctctcagaccttcccatctccctggctttccatgctcctctccctccacctcctggcttcaactgggtgagggccgtattcctgccactctgctccgcctcagccttgagaactccacgtgggctgggtgggaaggtgctgacgattttcacactgtgtttaccactccatcacctctcaacctttgcttcgacaggtcttcactcacgatttattcctccaggtctttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttcc

SEQ ID NO: 177711 - DNA, 1027 bp, Homo sapiens
  Payload ID: 14873
  Gene Symbol: RBM33
  Gene Name: RNA binding motif protein 33
  ENST ID: ENST00000440108
  CDS Start-End: 1-1027
caatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacaggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttggagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtgactcattctccaaggttaattcctccacagccccaggctccccctccaccgccaccgccgcctcagcagcagccgatcagaagcctgttccagccgcagccgctgcagccgctgcttccggtgcagcacccgcaccacccatccccgcctcagggaatgcacatgcctccccagctagagaccccaaggatgatgatgaccccgccacccgtgactccacagcagcccaagaacatacacatcaacccgcacttcaaagggacggtggtcacgcctgttcaagtgcccttgctaccagttccgagccagccgagacctgccgtgggaccccagagattcccaggccctccagaatttccacagcatacacctggacctgttcccaacagtttcagccagcccccac

SEQ ID NO: 177712 - DNA, 547 bp, Homo sapiens
  Payload ID: 14873
  Gene Symbol: RBM33
  Gene Name: RNA binding motif protein 33
  ENST ID: ENST00000438356
  CDS Start-End: 464-547
cttcccacatgctttcagaagtggagcatgcctcatttctttctcttgcttttcatcattgtccatatcaggtcattttcagtcaggcacaggaagtgcagttttccactgtagtttggataggttcagtactctaaaataaaaccagtcactgcagatagatttccattgcagaagattcttccataaagaagtgatctgtagaacacttgcttctttatcccaccatatagtcttattagttgtgcagggaggagagagcgatggcttttttcacccagaaggccagccccagcggcttccccagcctccggaagtgggaccacagcctgcccgcaaggtgacgctgaccagggggggcctccagcagcccccacatctgccagcggggccccacgcacactcgcctgtccctccagggatcaaaagcatccaaggaattcacccggcgaagaaggccatcatgcacggacgaggcagaggagtggccggtcccatgggccgggggcgcctgatgccaaacaagcagaacctgcgggtggtggag

SEQ ID NO: 177713 - DNA, 2054 bp, Homo sapiens
  Payload ID: 14874
  Gene Symbol: RBM34
  Gene Name: RNA binding motif protein 34
  Uniprot ID: P42696
  ENST ID: ENST00000408888
  CDS Start-End: 232-1524
gcttcaaccactcccagaagacgtccttcactcccaaaatgaggcttttctgaaacggcgaggaccaccaaccgacggcgacaaacctgctccctcacccagcgcctcccttcgccgccgcccggcggccgactgccggaggggagggggcgtggccagagagcggaagtgcccggaacccggaagtgcgagctggcgcgcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaaagtgctattatctgctgatagcatcgtctgctattcatgtgttgagttttatacttctttatggatggtgtatgtgaaatgtggagacttccacattctcagtttattcacattgtgatactacctttgaaggtttttttgtttttgttttgttttttgagatggagtttggctgttgtctcccaggctggagtgcagtggcgtgatcttggctcactgcaacctctgccttctgggttcaagcgcttctcctgcctcagcctcccaagtagctgggattacaggcgcctgccaccacgcctggctaattttttgtatttttagtagagacggggtttcaccatgttggccaggctggtctcgaactcctgacctcaggtgatccacctgccttggcctctcaaagtgctgggattacaggcgtgagtcactgcacccaagcctcctttctcttttgcctattaaacctctgctcttaacctta

SEQ ID NO: 177714 - DNA, 1273 bp, Homo sapiens
  Payload ID: 14874
  Gene Symbol: RBM34
  Gene Name: RNA binding motif protein 34
  ENST ID: ENST00000447801
  CDS Start-End: 1-1227
ttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgagaatacagattctgttcatcttgctctgaaattaaataattctgaactcatggggagaaaactcagagtcatgcgttctgttaataaagaaaaatttaaacaacaaaattcaaatccacgattgaagaatgtcagtaaacctaagcagggacttaattttacttccaaaactgcagaaggacatcctaaaagcttatttattggagaaaaagctgttctccttaaaacgaagaagaaaggacagaagaaaagtggacgccctaagaaacagagaaaacagaaataacaaccaggaactgctttttcttttcctgctgagtactgctaataaa

SEQ ID NO: 177715 - DNA, 667 bp, Homo sapiens
  Payload ID: 14874
  Gene Symbol: RBM34
  Gene Name: RNA binding motif protein 34
  ENST ID: ENST00000429912
  CDS Start-End: 33-667
gcagctgcagtctgggagtctttggagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaaagttggcagacagttctcctttcagattgatgctcagaccttgcttatccatatccagcaatactttatattgtatttaccgtttcacaatttacttttgggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaa

SEQ ID NO: 177716 - DNA, 882 bp, Homo sapiens
  Payload ID: 14874
  Gene Symbol: RBM34
  Gene Name: RNA binding motif protein 34
  ENST ID: ENST00000474086
  CDS Start-End: 1-260
gagtaagaatggccttggaagggatgagcaaacggaagagaaagagaagtgtccaggagggagagaatcctgacgacggcgttcgcgggagtccgccggaagactacaggcttggacaggtcgccagtagcttatttcgcggcgaacaccattccagaggtggcaccggtcggctggcgtccctcttcagttctctggagccccagattcaacccgtgtacgtgcctgtgcctaaaggaaagcgctctagcgagtgctgatttagaagaagaaattcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaagaagctgaagtcgttttttaaagagtatggacaaatagaatctgtacgatttcgttctctgattccagcagagggaacgctatccaaaaagttggcagcaataaaacgtaaaattcatcctgatcagaaaaatattaatgcctatgttgtgtttaaggaggagagtgctgccacgcaagcattgaaaagaaatggggcccagattgcagatggatttcgtattagagttgatctcgcatctgagacctcatctagagacaagagatcggtttttgtggggaatctcccttataaagttgaagaatctgccattgagaagcactttctggactgtggaagtatcatggccgtgaggattgtgagagacaaaatgacaggcatcggcaaagggtttggctatgtgctctttgaggta

SEQ ID NO: 177717 - DNA, 852 bp, Homo sapiens
  Payload ID: 14875
  Gene Symbol: RBM38
  Gene Name: RNA binding motif protein 38
  ENST ID: ENST00000342690
  CDS Start-End: 130-363
cgggacgggcgccggagtggtcgggcctggcggctggacgggcgcccctcgctgccccgcgcgctccccgccgccccccatgagcgcagccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggggattatttttgtccttgaaggccacatttcccaggccttgaactttgacgggaggagctggaatccaggaggcatctttgtgggagagccccaggtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagc

SEQ ID NO: 177718 - DNA, 2193 bp, Homo sapiens
  Payload ID: 14875
  Gene Symbol: RBM38
  Gene Name: RNA binding motif protein 38
  ENST ID: ENST00000344785
  CDS Start-End: 15-386
ccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacggaggcgactttatgttcagaaaatgagtcctcctgggccgtggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 177719 - DNA, 2382 bp, Homo sapiens
  Payload ID: 14875
  Gene Symbol: RBM38
  Gene Name: RNA binding motif protein 38
  Uniprot ID: Q9H0Z9
  ENST ID: ENST00000356208
  CDS Start-End: 176-895
gcagcgccggtcgggagcgcagcgcggcgcacgtcggcgcgcacggcgggacgggcgccggagtggtcgggcctggcggctggacgggcgcccctcgctgccccgcgcgctccccgccgccccccatgagcgcagccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaa

SEQ ID NO: 177720 - DNA, 760 bp, Homo sapiens
  Payload ID: 14875
  Gene Symbol: RBM38
  Gene Name: RNA binding motif protein 38
  ENST ID: ENST00000371219
  CDS Start-End: 270-746
ataaacatcagcttaagtaaaaacgtcttgaagacactttcctgcttaccttccaagcatagcgtcgcaaactccttctcagaggaaagtctcggccctcactggtgggcaagtccaggcggccccccaagctcccttcggggttcatttttgccctatccccgcaggggattatttttgtccttgaaggccacatttcccaggccttgaactttgacgggaggagctggaatccaggaggcatctttgtgggagagccccaggtgaccatggccgaccgggcggcagctgagagggcttgcaaagacccgaaccccatcatcgacggccgcaaggccaacgtgaacctggcatatctgggcgccaagccgcggagcctccagacgggctttgccattggggtgcagcagctgcaccccaccttgatccagcggacttacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgcc

SEQ ID NO: 177721 - DNA, 686 bp, Homo sapiens
  Payload ID: 14875
  Gene Symbol: RBM38
  Gene Name: RNA binding motif protein 38
  Uniprot ID: Q9H0Z9
  ENST ID: ENST00000440234
  CDS Start-End: 155-520
gcgcggcgcacgtcggcgcgcacggcgggacgggcgccggagtggtcgggcctggcggctggacgggcgcccctcgctgccccgcgcgctccccgccgccccccatgagcgcagccccgcgcggcccgggtccgtaggcggcggggcgccccccatgctgctgcagcccgcgccgtgcgccccgagcgcgggcttcccgcggcccctggccgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtgaccatggccgaccgggcggcagctgagagggcttgcaaagacccgaaccccatcatcgacggccgcaaggccaacgtgaacctggcatatctgggcgccaagccgcggagcctccagacgggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcc

SEQ ID NO: 177722 - DNA, 2488 bp, Homo sapiens
  Payload ID: 14876
  Gene Symbol: RBM39
  Gene Name: RNA binding motif protein 39
  Uniprot ID: Q14498
  ENST ID: ENST00000253363
  CDS Start-End: 25-1617
ggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcc

SEQ ID NO: 177723 - DNA, 2792 bp, Homo sapiens
  Payload ID: 14876
  Gene Symbol: RBM39
  Gene Name: RNA binding motif protein 39
  ENST ID: ENST00000338163
  CDS Start-End: 295-1566
gccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagctttgtttgttattatgttttggaatgaaatttggtcagataatatgattacgcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 177724 - DNA, 2831 bp, Homo sapiens
  Payload ID: 14876
  Gene Symbol: RBM39
  Gene Name: RNA binding motif protein 39
  Uniprot ID: Q14498
  ENST ID: ENST00000361162
  CDS Start-End: 386-1960
gcgagagcccgtgctgagggctctgtgaggccccgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcc

SEQ ID NO: 177725 - DNA, 1026 bp, Homo sapiens
  Payload ID: 14876
  Gene Symbol: RBM39
  Gene Name: RNA binding motif protein 39
  ENST ID: ENST00000374038
  CDS Start-End: 332-1026
gtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaa

SEQ ID NO: 177726 - DNA, 612 bp, Homo sapiens
  Payload ID: 14876
  Gene Symbol: RBM39
  Gene Name: RNA binding motif protein 39
  ENST ID: ENST00000397370
  CDS Start-End: 306-593
aagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaaaatactttgcattaaaaatttagatcttcttacatggaagaggtcaaatccagttatagcaaaacacctttactgcagaggccatataaccaaaaagtccaaaggcccagcccagtggaccatttacttcagtgatgttcagtacaaaatttcactgccattaaagactttggaaagtcccttttaagttgtaacaggatttgact

SEQ ID NO: 177727 - DNA, 2883 bp, Homo sapiens
  Payload ID: 14876
  Gene Symbol: RBM39
  Gene Name: RNA binding motif protein 39
  ENST ID: ENST00000403542
  CDS Start-End: 348-470
gtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggc

SEQ ID NO: 177728 - DNA, 526 bp, Homo sapiens
  Payload ID: 14876
  Gene Symbol: RBM39
  Gene Name: RNA binding motif protein 39
  ENST ID: ENST00000425184
  CDS Start-End: 1-72
acttgcctaacgatatctcacctctactcccatgaattcacctttgattccagtgtgaactgtcaatcataaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttg

SEQ ID NO: 177729 - DNA, 432 bp, Homo sapiens
  Payload ID: 14876
  Gene Symbol: RBM39
  Gene Name: RNA binding motif protein 39
  ENST ID: ENST00000449489
  CDS Start-End: 14-136
gcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaaatccctaaatgcttcatagtaagtatgtcagtctttctcactacaactgtgttaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagt

SEQ ID NO: 177730 - DNA, 716 bp, Homo sapiens
  Payload ID: 14876
  Gene Symbol: RBM39
  Gene Name: RNA binding motif protein 39
  ENST ID: ENST00000434927
  CDS Start-End: 136-716
ggcagcgcgggtttttgcccggaaagaggcgctctcgttcgggtctcccagtttctgtttttggagttgacagcagagttttaaatattggatattgaagtcttcattttcgtgtgtttcgtgcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaa

SEQ ID NO: 177731 - DNA, 2124 bp, Homo sapiens
  Payload ID: 14876
  Gene Symbol: RBM39
  Gene Name: RNA binding motif protein 39
  ENST ID: ENST00000444878
  CDS Start-End: 322-444
gaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaa

SEQ ID NO: 177732 - DNA, 1008 bp, Homo sapiens
  Payload ID: 14876
  Gene Symbol: RBM39
  Gene Name: RNA binding motif protein 39
  ENST ID: ENST00000448303
  CDS Start-End: 1-1008
aagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgc

SEQ ID NO: 177733 - DNA, 2149 bp, Homo sapiens
  Payload ID: 14876
  Gene Symbol: RBM39
  Gene Name: RNA binding motif protein 39
  ENST ID: ENST00000429968
  CDS Start-End: 330-473
gtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaaacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaa

SEQ ID NO: 177734 - DNA, 441 bp, Homo sapiens
  Payload ID: 14876
  Gene Symbol: RBM39
  Gene Name: RNA binding motif protein 39
  ENST ID: ENST00000455343
  CDS Start-End: 32-154
gcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttaacgacgttcccgaagcaaaagtccattcagaaaagacaaga

SEQ ID NO: 177735 - DNA, 1068 bp, Homo sapiens
  Payload ID: 14876
  Gene Symbol: RBM39
  Gene Name: RNA binding motif protein 39
  ENST ID: ENST00000453310
  CDS Start-End: 332-454
gtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaaaatactttgcattaaaaatttagatcttcttacatggaagaggtcaaatccagttatagcaaaacacctttactgcagaggccatataaccaaaaagtccaaaggcccagcccagtggaccatttacttcagtgatgttcagtacaaaatttcactgccattaaagactttggaaagtcccttttaagttgtaacaggatttgactattagtgtggatttcgataacccttctttagttaatgtaataaatgctctttgaagctggaaatatactggtttcttgcacccttgtagttttctctgggcttttatgcaaaagattgtattttctgaatgtcttagtatgttgctgtctttttacctgcctggggttgccttcagatgtgggtgaggacttgtttacaaaaagtcctagaagaccttaagttaaaattagctctccaattttcaagtgttttcttttggcagaataagttttgggtcctatgagaggtaaataggttggttgcctctcttgctatagcccatctagagcagaacaaaaactttgtttttgaggggg

SEQ ID NO: 177736 - DNA, 1018 bp, Homo sapiens
  Payload ID: 14876
  Gene Symbol: RBM39
  Gene Name: RNA binding motif protein 39
  ENST ID: ENST00000412738
  CDS Start-End: 187-309
attctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaaacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacag

SEQ ID NO: 177737 - DNA, 840 bp, Homo sapiens
  Payload ID: 14876
  Gene Symbol: RBM39
  Gene Name: RNA binding motif protein 39
  ENST ID: ENST00000426951
  CDS Start-End: 1-260
ctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttagtatgtaactatagttatgattttggtttgagggttattctctgggtattcagatggcagtttaacttgagtgatttgaattgtgaatttttatttttttaatgattggttaaaaagtattgaattaaggatattggcattgaatactagtaaagtgaaaatacagtgcatagacaaataagtaaaaatttgcttttactaggcatactgactattttctgttaaactatcagagtttctaaattgtatgccagtcaacgcaaactggatgaaagcactagagtgcttgaaaaagatgacattgtagtgcccaaatacctaagaaagcttaacaagtgtctgggctgttacagtatttgctaaatacatatttacttaaaattgtaaagttctgatgaatactaagttacacatgtataattagttaacagtaaataaaaagtctgtcaccgtggctgttttcagctgaaatgtcaggccagttgtgaatttgttgtgtatgctcattgataaagatccttttttgggctcatctgtatttaaggtttgttaataataataaaaggtattccaaactaaaa

SEQ ID NO: 177738 - DNA, 577 bp, Homo sapiens
  Payload ID: 14876
  Gene Symbol: RBM39
  Gene Name: RNA binding motif protein 39
  ENST ID: ENST00000416108
  CDS Start-End: 153-275
ctctttgcccctaaaatggcagcgcgggtttttgcccggaaagaggcgctctcgttcgggtctcccagtttctgtttttggagttgacagcagagttttaaatattggatattgaagtcttcattttcgtgtgtttcgtgcgtttagagaaaatggcagacgatattgatattgaagcaatgcttgaggctccttacaagaagacttgcctaacgatatctcacctctactcccatgaattcacctttgattccagtgtgaactgtcaatcataaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagca

SEQ ID NO: 177739 - DNA, 594 bp, Homo sapiens
  Payload ID: 14876
  Gene Symbol: RBM39
  Gene Name: RNA binding motif protein 39
  ENST ID: ENST00000416529
  CDS Start-End: 53-241
ccgaacacgagcaccacaggcgcccgaaggccggaacaggcgtttagagaaaatggcagacgatattgatattgaagcaatgcttgaggctccttacaagaagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggatgagaacaagttgagcagtgccaacggccatgaagaacgtagcaaaaaaatactttgcattaaaaatttagatcttcttacatggaagaggtcaaatccagttatagcaaaacacctttactgcagaggccatataaccaaaaagtccaaaggcccagcccagtggaccatttacttcagtgatgttcagtacaaaatttcactgccattaaagactttggaaagtcccttttaagttgtaacaggatttgactattagtgtggatttcgataacccttctttagttaatgtaataaatgctctttgaagctggaaatatactggtttcttgca

SEQ ID NO: 177740 - DNA, 611 bp, Homo sapiens
  Payload ID: 14876
  Gene Symbol: RBM39
  Gene Name: RNA binding motif protein 39
  ENST ID: ENST00000433027
  CDS Start-End: 293-412
catttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaaatccctaaatgcttcatagtaagtatgtcagtctttctcactacaactgtgttagacaaactttctgcctccttggaaagctctacatctccttgtgattggagtgtgggtttcaagattccagaaggaggaaaaaaagcaagagcagaagtcgtagtcatgaacgaaagagaagcaaaagtaaggaacggaagcgaagtagagacagagaaaggaaa

SEQ ID NO: 177741 - DNA, 2421 bp, Homo sapiens
  Payload ID: 14876
  Gene Symbol: RBM39
  Gene Name: RNA binding motif protein 39
  Uniprot ID: Q14498
  ENST ID: ENST00000528062
  CDS Start-End: 312-1838
acagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttacagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctg

SEQ ID NO: 177742 - DNA, 754 bp, Homo sapiens
  Payload ID: 14876
  Gene Symbol: RBM39
  Gene Name: RNA binding motif protein 39
  ENST ID: ENST00000476806
  CDS Start-End: 1-180
ctggaaaggactggaattgatttgggaacaactggtcgtcttcagttaatggcaagacttgcagagggtacaggtttgcagattccgccagcagcacagcaagctctacagatgagtggctctttggcatttggtgctgtggcagttgaggctcttcattgttcctgcactgagctgtagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaa

SEQ ID NO: 177743 - DNA, 871 bp, Homo sapiens
  Payload ID: 14876
  Gene Symbol: RBM39
  Gene Name: RNA binding motif protein 39
  ENST ID: ENST00000490484
  CDS Start-End: 1-738
acagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagaggggtctggctctgttgcccaatttggagtgcagttgtgcgatcctggctcaccgcaacctctgcctctttggctgaagccatcctcccaccctaatctctaaatagctgggactaacagttgcaaacaaccaccaccacgcctggctaatttctgtggtacaggtttgcagattccgccagcagcacagcaagctctacagatgagtggctctttggcatttggtgctgtggcag

SEQ ID NO: 177744 - DNA, 686 bp, Homo sapiens
  Payload ID: 14876
  Gene Symbol: RBM39
  Gene Name: RNA binding motif protein 39
  ENST ID: ENST00000615771
  CDS Start-End: 1-490
acaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcaggaaaaaaaagacaaattctgttattatttaaagtttattgacactgttcacatggtcctatcttcaagttccttcagtatacaccagttacatttcttcagctccctgagatgccaattttgagcacctaggacccagatttgcaaacaagactttcccagcagactgaagcttcagctttagctgcagctgcctctgttcagccacttgcaacacaatgtttccaactctctaaca

SEQ ID NO: 177745 - DNA, 1694 bp, Homo sapiens
  Payload ID: 14877
  Gene Symbol: RBM4
  Gene Name: RNA binding motif protein 4
  Uniprot ID: Q9BWF3
  ENST ID: ENST00000310092
  CDS Start-End: 149-1243
actttcttgagtggccaatccggttgtaggctcacctcccccttctactcagagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttag

SEQ ID NO: 177746 - DNA, 921 bp, Homo sapiens
  Payload ID: 14877
  Gene Symbol: RBM4
  Gene Name: RNA binding motif protein 4
  Uniprot ID: Q9BWF3
  ENST ID: ENST00000398692
  CDS Start-End: 68-499
gttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactta

SEQ ID NO: 177747 - DNA, 1763 bp, Homo sapiens
  Payload ID: 14877
  Gene Symbol: RBM4
  Gene Name: RNA binding motif protein 4
  Uniprot ID: Q9BWF3
  ENST ID: ENST00000408993
  CDS Start-End: 235-1329
actgctgcggccgccgccattttagcgttttgtcagaagcgtccgcgccgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataa

SEQ ID NO: 177748 - DNA, 2321 bp, Homo sapiens
  Payload ID: 14877
  Gene Symbol: RBM4
  Gene Name: RNA binding motif protein 4
  Uniprot ID: Q9BWF3
  ENST ID: ENST00000409406
  CDS Start-End: 778-1872
accttgctttttttcgcccaccctgtcccgcgcccgacatggctgctcttggagcctcgagatttccactgggataaccccctttcccttatatctgacagttacattctcgtttcgggaatttctcgggccgtgagacatcgtctggttaatgaatctgaagctcttttccgcggccgcgcatttcagtgttcggcaggagctaggacggtgccccgagagaggcgttcaccactccagtatttcctttatctcccactcctcgctgtctgatccgagtcgcgcgttcattacttccaaaggaaactcaaatgtagctattacaaggcccattttcccggaaatgatggctgctttggttcctacgtgaggaaaagcctgttgataatttcaggcaggcagtcagcaagcctagtagacttttgttttctgttgtcctcctagtggatagaaaagcctagtacccccatttcttcatatgctgtctttcatgcccatttctgttggaaggtatcggttcttaccaaaccctttgtctactaaggacctccctattgcagacgtcttcttattcttacaggttcatggcggctactatagcaggccttagttcactcccacttccatttgattattgtgtggaggtgtgtgtgcaggcgtgtgagagagaaaactggaaatatacattagagtgaaagtcgttgtcttttgtgaacggatgtgggcctgaggtcttttgtcagatgtcttgtttttctctcccaggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcggtgcgggaaagaggggcactggtccaaagagtgtccgatagatcgttcaggccgcgtggcagacttgaccgagcaatataatgagcaatacggagcagtgcgtacgccttacaccatgagctatggggattcattgtattacaacaacgcgtacggagcgctcgatgcctactacaagcgctgccgtgctgcccggtcctatgaggcagtggcagctgcagctgcctccgtgtataattacgcagagcagaccctgtcccagctgccacaagtccagaatacagccatggccagtcacctcacctccacctctctcgatccctacgatagacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatgagcgggagcagtatgccgatcgggcgcggtactcagccttttaaagcttgaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaactt

SEQ ID NO: 177749 - DNA, 1337 bp, Homo sapiens
  Payload ID: 14877
  Gene Symbol: RBM4
  Gene Name: RNA binding motif protein 4
  Uniprot ID: Q9BWF3
  ENST ID: ENST00000396053
  CDS Start-End: 99-620
agagcactgctgcggccgccgccattttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaagataacccctgtgacagaaggctactgttgctgtaacaaagggcatacatacattttcaagaactgcaatttaattttggagtccaggaaaagcagaagatgctgagatgtcatatatggcgaattgcactattctaaatgtgttttgttttaatctttcacagtaaacaagctttcagaaatgatggtcacaaggggtaggatatcaaggagcagccagtcattcacccaattccaacacacctacatgtcacactgtcacagagtgagagccacagttccagtagttcccctaattgaccaaatctcccttgccaaatcaaaagaaatcattcctagaattctctaatccttctattgatgatgggaactccagacaccaatggctgggggaaaaaaaaagttaactcacaccaagttcctctacttattacagacaaagggccaaatcttggtcttgatctgtgccaatcgacttcaaaagttgtgacgttcttggatcagttctgctagggtgagacccgaatttggatccccaacagttctggagtatttcatcctggcagcctcattaacatcaggctcctgggactgcaaccaactcagggttattcagtccatttgaggttcacacctggaaggtaagtttctttaaaagtcatcgctaaaaagaggttagttgaacaaccactgcttgcagtcaaaattcattttaaaatgtcctagcaataccttttgaagaccacaatatatgaatttaatatttaactttgaaacataagagacaggttatctgatagatttataccagcttacttcggaa

SEQ ID NO: 177750 - DNA, 782 bp, Homo sapiens
  Payload ID: 14877
  Gene Symbol: RBM4
  Gene Name: RNA binding motif protein 4
  ENST ID: ENST00000510173
  CDS Start-End: 61-782
cagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggcaaacgaatgcacgtgcagttgtccaccagccggcttaggactgcgcccgggatgggagaccagagcggctgctatcgacacctgttgccgacctcaggagctgctgccacagctgctgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggtatga

SEQ ID NO: 177751 - DNA, 654 bp, Homo sapiens
  Payload ID: 14877
  Gene Symbol: RBM4
  Gene Name: RNA binding motif protein 4
  ENST ID: ENST00000506523
  CDS Start-End: 48-500
gccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaagacatccagctctgtcacccaagctgcagtgtggtggcatgattgtagctcactgtaactttgaactcctgagctcaagggatcctcccgccttggcctcccagagtttttgcagggactatatgtgagccactgcgtctggtcaaaatgtagtttttcaagagtaatgctttaataaactgatttttttccccca

SEQ ID NO: 177752 - DNA, 757 bp, Homo sapiens
  Payload ID: 14877
  Gene Symbol: RBM4
  Gene Name: RNA binding motif protein 4
  Uniprot ID: Q9BWF3
  ENST ID: ENST00000532968
  CDS Start-End: 180-713
aggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggactta

SEQ ID NO: 177753 - DNA, 1011 bp, Homo sapiens
  Payload ID: 14877
  Gene Symbol: RBM4
  Gene Name: RNA binding motif protein 4
  Uniprot ID: Q9BWF3
  ENST ID: ENST00000530235
  CDS Start-End: 187-618
cgcgaggaggaggccctgctggtttctgtgcgggtgagactccgagcctttccactgcctttcttgtactgtgttaaatcttctctcactcccttgggcttcgggggtgtcctggtaggtccgcagtctccacacccgtcactgagagccgacctcggtcctcggcattgcgcggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctt

SEQ ID NO: 177754 - DNA, 1548 bp, Homo sapiens
  Payload ID: 14877
  Gene Symbol: RBM4
  Gene Name: RNA binding motif protein 4
  Uniprot ID: Q9BWF3
  ENST ID: ENST00000483858
  CDS Start-End: 68-601
gttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaaggtgaaccaccctctttgggtagagggctgaacacaaggctgtgtgcagaaaatggttggataagtaaaaggagaggtttggtaaagataacagctgttggctggctggtgatgaagaaataagtgtgggtgatggacttcttatgatgtagaatgcatgggacttaggggctttaccttaggcaaatgtctcctggagaaaagccactcaccttttatttggagcccctacggcttttgtgcttatcagtgcagaaacccttttctttgaaggctttctgagttactgggccttttttattttttatttttttgtagtagagcacagttcagagttcctcactctgaatttattgccctcagcacaggatcagaattctgcattttacgtgaagaacctctcaaaaacatgtcaagcgacacttataggaccagaatccttgttaagctgtcctaccttacacaaactctttaaagggttacagctcttgttgcttttatattatacctgtaccaagggattgtattttgagtttaaggccactctagaattacaaggctgattttaggacttcctggggaggaggcactggggttttaggggcggtaatgactgtcttttcattggtttggggggctggactttataagattttggtgaatagagcacttagatttgtgttatcttggagtcttaaccaaatgaatcttttgtgcctggagggcagcatgggtgatatgtggattgtcacttcatttggaagcatctcaaatccccagcattttgaatgcctacatgttgctcaaaggaaatgcttgttagagcattttggattttgaattttcagatttgggatgctaaaatggtacgtagaacgcaaatattccaaaatctgaggtctgaagcaacagtggcagttcaggggtggtgatcatggtgagttgctatctgaactcttctttcacctcctttgggttcccagtgtcaaaaagagtggtgtccttttttagcttaattaagcaggactgaacaaaaataataaaaaataaaaaaagccttattcaaatta

SEQ ID NO: 177755 - DNA, 582 bp, Homo sapiens
  Payload ID: 14877
  Gene Symbol: RBM4
  Gene Name: RNA binding motif protein 4
  ENST ID: ENST00000578778
  CDS Start-End: 75-542
ttttagcgttttgtcagaagcgtccgcgccgcgaggaggaggccctgctggtttctgtgcgggctcttgtcaggatggtgaagctgttcatcggaaacctgccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaaacctcaacaaagttgcatgtgggcaacatcagtcccacctgcaccaataaggagcttcgagccaagtttgaggagtatggtccggtcatcgaatgtgacatcgtgaaagattatgccttcgtacacatggagcgggcagaggatgcagtggaggccatcaggggccttgataacacagagtttcaagtagagacggggtttcaccgtgttaaccaggatggtctcgatctcctgacctcttgatccgcctgccttggcctcccaaagcgctgggattacaggc

SEQ ID NO: 177756 - DNA, 1662 bp, Homo sapiens
  Payload ID: 14878
  Gene Symbol: RBM41
  Gene Name: RNA binding motif protein 41
  Uniprot ID: Q96IZ5
  ENST ID: ENST00000372479
  CDS Start-End: 32-1273
acccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggtagcactacagaaattagtggtagctagaatatatataaattgtgggtcctggatggtctttcttgaattggaatcttggatctaggatttatgtatagacaccagtttgtttggagttgaagaggaaaaactaactgagggaggggaaaaaagtaatttcagcttttggagagaactggtagaaaacattttctattatataattgaagactatataggacagatgatatgctgagtatgaagggtaaagtgcaaagagtattattttctcaggatgaattacaacggattattcctaaggatttttaaaaatctttataatttttctggggtcctcaatatttgtctctagagataacattctttcttagactgcttcgtatacacagaaataaaaaactaattaaatgttgaaa

SEQ ID NO: 177757 - DNA, 2579 bp, Homo sapiens
  Payload ID: 14878
  Gene Symbol: RBM41
  Gene Name: RNA binding motif protein 41
  Uniprot ID: Q96IZ5
  ENST ID: ENST00000372487
  CDS Start-End: 28-1245
aagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattacc

SEQ ID NO: 177758 - DNA, 680 bp, Homo sapiens
  Payload ID: 14878
  Gene Symbol: RBM41
  Gene Name: RNA binding motif protein 41
  ENST ID: ENST00000434854
  CDS Start-End: 1-610
ggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaaggtattatacctgaagaaccttagccctcgggtgactgaaagagatcttgtgtcattgttcgctcggttccaggagaaaaaaggacctccaatt

SEQ ID NO: 177759 - DNA, 3315 bp, Homo sapiens
  Payload ID: 14878
  Gene Symbol: RBM41
  Gene Name: RNA binding motif protein 41
  Uniprot ID: Q96IZ5
  ENST ID: ENST00000495517
  CDS Start-End: 51-986
tgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaagatgaaccccaaaagaagaacaaaggtgatcccatgaacaacctggaaagtttttaccaagagatgataatgaaaaaacgtcttgaagagtttcaacttatgagaggacttaccagttttcccagagaagacttccaaaatctttcttacgagggtactaccagcgttctaggagccaaatggcagaaaaggactgggaggacctcaacatttagtattctcttagtttccttgctttcagaaacagtgttcacatcttcagccatgtatggcattccccatcttctgacaatgagcctcaagttttctaccaggattggcaagttatcttttaccccatagcatattgtgagggagggtatttaaaaatcatattggcttttagacagccttcaactgatttgccttattttaaccccatcccttcacatttatttctgaaggtaagtgaaattatcagttcctgaactatttaaggattcttaagtggtgacaggtgtgttcttggctctctccactaccagtttaaaattcagctttcttcagtgtgctgagttggttcctgctcatccaattatttttcatcttccagattattattgctgttgtctccttttcttgttcctcctgaccttgttgatttgtgtttttttttttttttttttaagtgcctatagttttagagagttttctggatggaatgaaattaaatgaatgtgttcaatccaccatttttatgtgaaactaattctaatcataatgaaagagttttcttacggctgagcatggtgtctcacgcctgtaatcccagcattttgggaggccaaggcgggtggatcacctgagtttgggagttcaagaccagcctggacaacatggtgaaaccccacgtctactaaaaatacaaaaattagccaggtgtggtggcacatgactgtaatcccagctactcgggaggctgaggcatgagaatcacttgagcctgggaggccaaggttgcagtgagcagagattgcgccactgcactccagcctgggtgacagagtgagactttgtctcaaaaagaaaaaaacaaagagtgccttacctcctttatatgatattttggttgatcctcaatttgttttaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggtagcactacagaaattagtggtagctagaatatatataaattgtgggtcctggatggtctttcttgaattggaatcttggatctaggatttatgtatagacaccagtttgtttggagttgaagaggaaaaactaactgagggaggggaaaaaagtaatttcagcttttggagagaactggtagaaaacattttctattatataattgaagactatataggacagatgatatgctgagtatgaagggtaaagtgcaaagagtattattttctcaggatgaattacaacggattattcctaaggatttttaaaaatctttataatttttctggggtcctcaatatttgtctctagagataacattctttcttagactgcttcgtatacacagaaataaaaaactaattaaatgttgaaatatttctttactagagcccatttgccatatttcatccacctagtaaataaaagagtaggacccccaggcctaagcatcaacaaatgctattaagtcagaactatcagcagtaatagtaggtagtttcataagtcagttgacttatttaatgaatgcttcctccacaagttatcagtcttcaaaaagctatatatttttctagtgaaatattttagatcaaaatgttggtgttctcacagccatttaagctagcaaccattgagtatcattgaattcatagcaataaacattgattaagtgtctaatatatgttaaatattaggcatatgaattttagaagaggaacatacaagcaaagaatgccaaacggaaatggaaataaagcgttctctagaaaagaggatgccagtcacaaatcccccagttgtttgtttatggttgctggaaaataaaaaaacaatatacagagaggaagtagtacaaactggagtcagacctgtacagccacacttaacattctatgaccttggcaagtcacttaatctgagcctcacatttttcatctataaagtgaggataataatgctacttacctcactgggttgtgaagatgaactgagatattatccaggctgaagaacagaaaggaaaacaatgaataaaattgaacaagagtatagaacctgtgtgacaccattaagcattcctacatatttctaatgggagtacaggaaaaaaggaaaagaaatgaaggagcagaaaaatattctaagaaataatggctataaatacccccgatttgatgagagacattaacctatacatcccagaagaaaaa

SEQ ID NO: 177760 - DNA, 1680 bp, Homo sapiens
  Payload ID: 14879
  Gene Symbol: RBM42
  Gene Name: RNA binding motif protein 42
  Uniprot ID: Q9BTD8
  ENST ID: ENST00000262633
  CDS Start-End: 106-1548
gtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagctgtggccccccagagggcccctatcctgcgtccagccttcgtcccccacgtgctacagagagcagattccgctctctcctctgcagcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttccac

SEQ ID NO: 177761 - DNA, 1609 bp, Homo sapiens
  Payload ID: 14879
  Gene Symbol: RBM42
  Gene Name: RNA binding motif protein 42
  Uniprot ID: Q9BTD8
  ENST ID: ENST00000588161
  CDS Start-End: 125-1477
cccgtcgcttttgctggacgtcatcctcgggagcccacccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttccac

SEQ ID NO: 177762 - DNA, 771 bp, Homo sapiens
  Payload ID: 14879
  Gene Symbol: RBM42
  Gene Name: RNA binding motif protein 42
  ENST ID: ENST00000586618
  CDS Start-End: 87-641
ccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaaccagtttcaataaatttacgttcatttcc

SEQ ID NO: 177763 - DNA, 1487 bp, Homo sapiens
  Payload ID: 14879
  Gene Symbol: RBM42
  Gene Name: RNA binding motif protein 42
  ENST ID: ENST00000589871
  CDS Start-End: 24-1400
cggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagattccgctctctcctctgcagcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccat

SEQ ID NO: 177764 - DNA, 1469 bp, Homo sapiens
  Payload ID: 14879
  Gene Symbol: RBM42
  Gene Name: RNA binding motif protein 42
  ENST ID: ENST00000592202
  CDS Start-End: 88-1368
cccggacgaagggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagatgacttccggatcttctgtggggatctgggcaatgaggtgaacgatgacatcttggcacgcgccttcagccgcttcccatccttccttaaggccaaggtgatccgtgacaagcgcacaggcaagaccaagggctacggcttcgtcagcttcaaggaccccagcgactacgtgcgcgccatgcgtgagatgaatgggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatcccctgccccaaaa

SEQ ID NO: 177765 - DNA, 1328 bp, Homo sapiens
  Payload ID: 14879
  Gene Symbol: RBM42
  Gene Name: RNA binding motif protein 42
  ENST ID: ENST00000589559
  CDS Start-End: 78-1238
gggggagagtagacagcagaaccagcggcggcggctaagcagagactgtagtagcggcgacagcgacgacggcagcgatggctggggcggggccagccccgggactcccgggtgcaggaggacccgtggtcccgggtcctggcgctggcatcccgggcaaaagcggcgaggaacgcttgaaggaaatggaggcggagatggccctgtttgagcaggaagttctgggggctccagtacctggaatcccaactgctgtgcctgcggtgcccactgtccccacggtccccacagtagaagcgatgcaggtcccagcggctcctgtgatccgcccaattatcgcgaccaacacataccagcaggtccagcagactctggaggcccgagcagctgctgcagccacagtagttcctcccatggtgggtggccctccttttgtaggccctgttggctttggccctggtgatcggagtcacctggacagcccagaggctcgagaagccatgttcctgcggcgggcagcagccggcccccgccctatggccctacggccccctcaccaggccctcgtgggcccccctctgcctgggccccctggaccacccatgatgctgccaccaatggctcgggctccagggcccccgctgggctccatggctgcactgaggccccctctggaagagccagcagcaccccgagagctgggcctaggcctggggttgggcctgaaagagaaggaagaggcagtggtggcggcggcggctgggctggaggaggctagcgcggctgtggccgtgggggcaggaggtgccccagctggccctgcagtcattgggcccagcctgccgctggccctggccatgccattgcccgagcctgagcccctgcccctcccgttggaggtcgtccgcggcctcctgcccccgctgcgcattcctgaactcctgtccctgcgtcctcggccccggccccctcggccagagccacccccaggcctcatggctcttgaggtcccagagcccctgggtgaagacaagaagaaggggaagccagagaaattgaaacggtgcattcgcacagcggcagggagcagctgggaggaccccagcctgctggagtgggatgcagggaagtatgtgggctcgcgccccatcaagcttcgcaagagcatgtggaaggaccggaatctggacgtggtccgcaagaagcagaaggaaaagaagaagctgggcctgagatagggtctgtggccaggcacccgctcccacctggccgggcgctggctcctccctcagttctctttggaaaacccccagctgtccacccatccc

SEQ ID NO: 177766 - DNA, 4192 bp, Homo sapiens
  Payload ID: 14880
  Gene Symbol: RBM43
  Gene Name: RNA binding motif protein 43
  Uniprot ID: Q6ZSC3
  ENST ID: ENST00000331426
  CDS Start-End: 153-1226
cgggtggaaggaccgcccttttcttcgtagcctccaagggagctggaacaaaaaacgaaaccaaaacctgcctgctcgctcctctccccatcgcctgcgttccgctggttgtgggctttctgcggccgctgagggcgcgtctcccctccgccatggcatcagttttgaatgtcaaggaatccaaagctcctgaaagaacggttgtagttgctggtcttccagttgacctttttagtgatcaattattggccgtattagtgaagagccacttccaagacattaagaatgagggcggagatgttgaagatgtgatatatccgacaagaaccaagggagttgcatatgtaatattcaaagaaaaaaaagttgcagagaatgtcatcagacaaaagaaacactggctagcaaggaagactagacatgctgaactcacagtctctctcagagtctctcattttggtgacaagatcttcagctctgtaaatgccatccttgatctttctgtttttggaaaagaagttactctagaaactctggtaaaagacctgaaaaaaaaaatcccgagtttaagcttcagtcctttgaaacccaatggaagaatctccgtggaaggatcatttctggctgtcaagaggctcagagaatctttgctagcaagagcatgttctctcttagaaaaagacagaaattttaccagtgaggagagaaagtggaatagacaaaatccccagaggaatctacagagaagtaataactctttggcatcagtcaggaccttagtacctgagactgctagaagtggagaaatgcttgtgcttgacacagatgtttttctttacctgaaacacaagtgtggatcttatgaaagcacactgaaaaaattccacattctgagtcaggagaaagtggatggtgaaatcaccacaatttgtctaaaaagcattcaagttggttctcagccaaacaatgcaaaacatgtaaaagagctcattgaggaatggtcacatgctctttacttaaagcttagaaaagagacatttattttggaaggaaaggaaaatagagagaaaagaatgatcaaaagggcatgtgaacaattaagttcgagataccttgaagtcctgattaacctttataggacacacattgacattataggatcttcttctgacacttacctgtttaaaaaaggggtcatgaaattaatagggcaaaaggttagttaataaaatctcagcaatatagtcataagggctgctttctcttgctgagcagtgaccattgccatgaatgaggctagctttacacaccgtatctcatgaatccttatagtcatccttctttgtcagtgttgactatcctcatgttacagcggaagaaactaggatttggagaagttaaaacacttttctgaagttatccagttgacaaagaatgaggctgtggcttagcccagtctatctgattacacagataatatctaaggaataaaactttgaaaaaaactcaccaaacttttttttttttttttttgagatggagtctcgctctgttgtccaggctggagtgcagtggcgtgatctcggctcactgcaacgtccacctcctgggttcacaccattctcctgcctcaacctctggagtagctgggactacaggtgcccaccaccacgcccggctaatctttttgtatttttttagtagagatggggtttcaccgtgttagtcaggatggtctccatctcctgaccttgtgatccacccgcctcggcctcccaaagtgctgggattacaggcgtgagccactgcgcccagcaaactcaccaaactttgaaggaatcttactttctctgtaactccaaattattagagaataataattattaagaagtagccttaacatatgagaaatttgaaaggtgattattatgccatgggcaatttcttaacatttacagtttgtgtttactccgtgtagaattagaatactggcaaaaatcactggggaaactacttagatggaaagcatatcttatgcaggtaatcattatttgactaaattctattgtttcaaggctgctggccacataggatgtttttactatttttttagcctaagtgcttacataaaatggtgattcttttataattgtgcaagttgataatattaattgagtcattcttgtcacatccaactaaaacagactcaagaagctagggggaaaaagtacttgggacacataatattgctccaagaatgtaattctctgtgagcctggctactgaaactgcttgctgtaacctgagaccagttttgtctatagctgctgagataacttgctgtaactctaggactaattttacctatggccattgcccaccagttggagcttgccagctccccagggctttactaataccaatgaactttctcttaagatcacaagttggccgggcgtggtgactcatacctgtaatcccagcactttgggaggccgaggcgggtggatcacaaggtcaggagattgagaccatcctggctaacatggtaaaaccccatctctactaaaaatacaaaaattagccgggcatggtggtgggcgcctgtagtcccacctactcgggaggctagaggctgaggcaggagaatggcgtgaacccgggaggtggagcttgcagtgagccaagactgcactactgcactccagcctgggtgacagagcgagactccgtctcaaaaaaaaaaaaaaaaaaaaaagaaagaccacaagtaacattcttagttttaaataaaaccctcaaccttctctttgtttgttggacatactaaagatcacctagaattgaaattctttcttctcaaaacattaaatttagttttgtgtctacattttcattttgactttgacatgcatggtgtcagaagtgggatacaaagctgactcacctcatggagaatcattggcctttggagttatggcatgaggtacccatgttggggccctttgaaccccctacacccccaccactttcacaggtaatcctttctccctccagtaagtatctcttggacagaactctcagatatggttcgagttctgttttatttgggatatgattagggagaggtctttccccctcttgtttggtagatctgttgggtagaattattttccccctgttgacctcagctgcgaggtttggaccttgaggcttggatgagggaatttttccctttctttggagaaggcttatcattcttactggtaagcatgtattttattttctgtcctgtcttgtatttatttggcctttgtgtattcagtgcttgcatttacttggcttttgcatagttgacattaaatcagagcacccacgaaatgagctctcaaagttcaaaggcatgccagaatattttctggaactccagctagtaacatattcaaacattacagggatcatttagtctgtttttcttaaaactgaactaaaagatggaggctataaaatcatacactccaaataagatatgcatatttcattgatatcttgaggctaaaaaaaaataaaaacaaaaacaaaacacattcaggatacaaatattgccttgttaaaaaatactgtctcaaaggtggctgaaactttcttttctagacctttcccctccccttcttacagtatcccctctttatccttctctaaacagctattctaacatactacttaaataaaaacacttgaaaaccagcagatataaaacaaagtcattttgaccttcctactgttttttttttaaagcaaagattaaattcccatgtaaaaccttcctccctatacaaaaaagaatagcagcatttttatcttcaatgacaaagaattgagtccaagaaaatactgtataaaccttgttaaaaatcactcttgtcttttggtcctactcacataattcagcacactttcacagttaactattttttgttcaatttagtgcactggtgagtgactcaaactgctttatcccaaatttgatttacagcctttataagattgcctattaaaaaagcttaaagcttatccttagcccattttgtcagaaaaataatttgcatctaatcatttttataaactggtgaatttacgtgttttactatatcatgactaaaattctaaaataaaagttttaatatcttta

SEQ ID NO: 177767 - DNA, 579 bp, Homo sapiens
  Payload ID: 14880
  Gene Symbol: RBM43
  Gene Name: RNA binding motif protein 43
  ENST ID: ENST00000409092
  CDS Start-End: 52-258
ccgctggttgtgggctttctgcggccgctgagggcgcgtctcccctccgccatggtggcggcattgcgcgctcctgaaattcacgtacggcggtgcagtataggcccgctccagaggctcaggactaggctgtcacctcccacacccactgcccaggcgacggggacgccgccgttcgtcgaggagctgcttcgcaggctgttagggcttaactgttgtcctcccacgcctcggggggaacaaaagtggcctgattagccagaaatggaggtcacagctgccttttgaaaagggctaataagaacgattcgagccaaggacgcaagtcaggaagacatcctcatgtcttatgtctgccttggtgcgaattcttgtcttagcaaattcaaaatttatccttctgtgttttgttttgtttccatcaatcgcttaaaagccttggcaaggcctttaattcctgctctgaaatgctagagtcccggaaatgcaaaagcaagtacgtttttgttgacctggtggcggtagaggcgtcgtcattgaaaataaacaactgattttgagaaaatcaatataaacaaa

SEQ ID NO: 177768 - DNA, 4282 bp, Homo sapiens
  Payload ID: 14881
  Gene Symbol: RBM44
  Gene Name: RNA binding motif protein 44
  ENST ID: ENST00000316997
  CDS Start-End: 133-3291
gttacccaacaggcgccgcggctgctccggtggcgccactgactcggaggcggctgcggagagcggggcgctggcccgtggaggcggcagcggcggcggctttctagcggatccgagattatatatctttgaatgatgcaggccactgcagtggtggagacagcatctggtaaaggctaccacagtaatggaggcaacctccaaaaagataaaccttcaaatccaaagaaagaaaatttgttattatcctccaatggttgtgatgaagtcaaattgacttttcctgatgatgactggaattcttcgacactagagcaaagagctaataataaagaaatcagcaatattgacaaaatggatttattagagccatttttttcagtgagtcaagatactaacacagagagtactcagtttcagtcaagtgaacttgaagacagtactgactatgctttcttgaataaaacatattctataccttattcagagtcaaaactaaagaaggaaagtcttactcctttaagttcagaattagatcctgaagtgcagaaaaaagaggaggttttttttaatattttggaacatcaagataagactgttggcttggaaagaatctacaatatttcagatgctaattatagagaaagtgctgaagatacacaaaagcatgatacagatgaagactcacagcaggaatatcacagtgcagaagaacaagaatacataagtaaccatttatcttttgaccaaacaaaagcattagatatatctaatccagaagttgttgaattaggaaattcgggttatgaagttaaatgtgctagcaatgtagaagataatcgtgttaactcgggaagtggttctatcatctctttcgattcacttgatgtttatggacaagaagagtcacttcatgtctccaaatttcagaattctgttatgttaagagaatatcatgacctaaagcatgaaaagtataaggaacaagagactaattcaatgtaccacactgtatttgatggcagtgtactaagaagcaattctccaggaaaccaggaatctcaatctaagagtggttccttgagccctcaaaaagtattaaaaatgaaaatttatactgaaaacatgaaatctcaaataaatgaaggtaaagatttttgtggaaataaaattgttgagaacaaaatattactgcaccttgaaaatcctagcacattaccacaggataaagctttagagacattactccaaccctgtaaagattgtcaaacttcctggacctctgtttttgatgattcgataatttctgcctgtggatattatgaaagcctacaaaacactgctgactcagccttagatttttctgctatgctaccaaagatcgcagtcagagataatcaggcaatagaagataatacgtccctaaaagttgctcatagcagtaccacaaagaaaacatgctttcacaatataggagaaatgtgtactaaatcattgacagatgcagcaagttgtacagtcacaattaatcagacagtggacgttagcactgattttagggcttgtttcacaaccagcagggcaacaagtgcaagaccttctgtagtatctacatcaagcaacacagagataacaatgatgaataaaaaacgacctgatgaatggcaaaatgagaaacaaaaaagtgtggcttgtagtacagattggtcatacagtgaagattgtatagatacacagatggctataacaaaaggatcaggaaaatctctctccgttgacagtttaaaacctaatggaaattttctaaataaggatttcctggaattaagaaaagcatgtggtatcacagacctaaagaaacatcctgagagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaatagggaaggattaaatatgaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgcagactttagtcaactgaaacttggtgataaagactgcagacattaccaagagacaagcgaagactggtctgatgctaaagagagcctgacaggagttgacgtctcagggacacagggaaatcaagtagaacaagacacatggaatttggatcttacaggagaaatgaagaatgttgaaccctcacaaagagataaaggttatttgatacatgttggtggcctctgcccttcagtatctgaggccgatttaaggtctcatttccaaaaataccaagtttctgaaatttcaatttatgattctactaattacagatatgcatctcttgcttttacaaaaaacagcgatgcaaagatagctgtgaaagaaatgaatgggatagaaataaatggaaagtcagtaaatgtgtggcctgttaaaattcttggagaatatacatcaccactttcctccaaaaatgggaatagaattagttcgaataatttagagaaaagcaccaacaaacaaatccactcagaattctccatttctagattgcccagaactaggccacggcagctgggttctgagcaagacagtgaggttttcccttccgaccagggtgtcaagaagaattgtaagcagattgaatctgctaaattattacctgatacacccgttcaattcatacctccaaatacattgaaccttcgtagctttaccaagatcataaagagactggctgaactgcatccagaagtcagcagagaccatattataaatgcacttcaggaagtgagaataagacataaaggttttctgaatggcttatctattactactattgtggagatgacttcatctcttctgaaaaactctgcttccagttaggaattcaaaaaacaataaagagaacttccttggaaagtgtgtttcctccttcagagaatgttctacagcacttaggaaaaagtagtaataacaagatgatgtaattaaataggctctataaatgggctaagctgttaaaatattctactttatatccctcctttaaaatctagcaacagttgtctatacaatattaagatcttctctatatatttaaagttaaaatataatttttaataagtttttaaatttttttatttcaattttgttacttagaacattaagatgcatatttgtgatctaaagaaattgtcttgtccattttaaaaacctttattaagtcacttttaaaatgtattgaccaagaaggaggtttgttgttacatcaatgtttgtgaaatgatttccatacataaaaaatgtaatttacctgaactttgtcttaagactcttacattggattataggataacagataaataaactgtatagatacattcagtatcatacaacattttggaatgtgtatgctttcaggcttccaagataattaaattactgtcatgatacatttcatgcattttttatgacttcagtataaaacattcaggtgtgttagccttccctgggaagggtaaacttgtatgtgctttggtaaagtacttaaattccaatgttccctatagtgcttgcattcattttgtgaaaagttttgttgtattgttagaacaattttcaaaggctgattttatgccttatctgatagaaatatagaatagatagttctttaattgcttactttttaaaagtaatataatatttaagttgcatttttattaatagtaagattaacatttaagtctgcattttctttaaatgttttaaatgtttatagcattcaatgtgtagttggatttacttgactaaaaattagccctttaacgtttatatttgttgtatttatatttaataaaggcatctaatctttagt

SEQ ID NO: 177769 - DNA, 3449 bp, Homo sapiens
  Payload ID: 14881
  Gene Symbol: RBM44
  Gene Name: RNA binding motif protein 44
  ENST ID: ENST00000409864
  CDS Start-End: 255-3413
gaaattcgcacatatgcttcttcttgccgtggagactgatggagcctctgctgcggggcggggactctagcgagagggggacgtgaagttcgttccgtactcaggcgtgtgtgcccctgaccgacgcgtaggacgccctggaggacggcgccagctcctgacctagtgtgaggtgcccggacggtttccctaagaagcgcgtatttaagatgagatctgaagttgagcgtgaactcaagattatatatctttgaatgatgcaggccactgcagtggtggagacagcatctggtaaaggctaccacagtaatggaggcaacctccaaaaagataaaccttcaaatccaaagaaagaaaatttgttattatcctccaatggttgtgatgaagtcaaattgacttttcctgatgatgactggaattcttcgacactagagcaaagagctaataataaagaaatcagcaatattgacaaaatggatttattagagccatttttttcagtgagtcaagatactaacacagagagtactcagtttcagtcaagtgaacttgaagacagtactgactatgctttcttgaataaaacatattctataccttattcagagtcaaaactaaagaaggaaagtcttactcctttaagttcagaattagatcctgaagtgcagaaaaaagaggaggttttttttaatattttggaacatcaagataagactgttggcttggaaagaatctacaatatttcagatgctaattatagagaaagtgctgaagatacacaaaagcatgatacagatgaagactcacagcaggaatatcacagtgcagaagaacaagaatacataagtaaccatttatcttttgaccaaacaaaagcattagatatatctaatccagaagttgttgaattaggaaattcgggttatgaagttaaatgtgctagcaatgtagaagataatcgtgttaactcgggaagtggttctatcatctctttcgattcacttgatgtttatggacaagaagagtcacttcatgtctccaaatttcagaattctgttatgttaagagaatatcatgacctaaagcatgaaaagtataaggaacaagagactaattcaatgtaccacactgtatttgatggcagtgtactaagaagcaattctccaggaaaccaggaatctcaatctaagagtggttccttgagccctcaaaaagtattaaaaatgaaaatttatactgaaaacatgaaatctcaaataaatgaaggtaaagatttttgtggaaataaaattgttgagaacaaaatattactgcaccttgaaaatcctagcacattaccacaggataaagctttagagacattactccaaccctgtaaagattgtcaaacttcctggacctctgtttttgatgattcgataatttctgcctgtggatattatgaaagcctacaaaacactgctgactcagccttagatttttctgctatgctaccaaagatcgcagtcagagataatcaggcaatagaagataatacgtccctaaaagttgctcatagcagtaccacaaagaaaacatgctttcacaatataggagaaatgtgtactaaatcattgacagatgcagcaagttgtacagtcacaattaatcagacagtggacgttagcactgattttagggcttgtttcacaaccagcagggcaacaagtgcaagaccttctgtagtatctacatcaagcaacacagagataacaatgatgaataaaaaacgacctgatgaatggcaaaatgagaaacaaaaaagtgtggcttgtagtacagattggtcatacagtgaagattgtatagatacacagatggctataacaaaaggatcaggaaaatctctctccgttgacagtttaaaacctaatggaaattttctaaataaggatttcctggaattaagaaaagcatgtggtatcacagacctaaagaaacatcctgagagggaatttcaactttttaaagatacagagaaggatttgccatcaatgtgctgtcagaagataatgcagagagccataaaagcagagctgcaccttttaaatgttcactatcagatgtgtcgtcgccattgttgtgatatttacaaacttgtcatggaaaatagggaaggattaaatatgaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgcagactttagtcaactgaaacttggtgataaagactgcagacattaccaagagacaagcgaagactggtctgatgctaaagagagcctgacaggagttgacgtctcagggacacagggaaatcaagtagaacaagacacatggaatttggatcttacaggagaaatgaagaatgttgaaccctcacaaagagataaaggttatttgatacatgttggtggcctctgcccttcagtatctgaggccgatttaaggtctcatttccaaaaataccaagtttctgaaatttcaatttatgattctactaattacagatatgcatctcttgcttttacaaaaaacagcgatgcaaagatagctgtgaaagaaatgaatgggatagaaataaatggaaagtcagtaaatgtgtggcctgttaaaattcttggagaatatacatcaccactttcctccaaaaatgggaatagaattagttcgaataatttagagaaaagcaccaacaaacaaatccactcagaattctccatttctagattgcccagaactaggccacggcagctgggttctgagcaagacagtgaggttttcccttccgaccagggtgtcaagaagaattgtaagcagattgaatctgctaaattattacctgatacacccgttcaattcatacctccaaatacattgaaccttcgtagctttaccaagatcataaagagactggctgaactgcatccagaagtcagcagagaccatattataaatgcacttcaggaagtgagaataagacataaaggttttctgaatggcttatctattactactattgtggagatgacttcatctcttctgaaaaactctgcttccagttaggaattcaaaaaacaataaagaggtaaagtaatcata

SEQ ID NO: 177770 - DNA, 1427 bp, Homo sapiens
  Payload ID: 14881
  Gene Symbol: RBM44
  Gene Name: RNA binding motif protein 44
  Uniprot ID: Q6ZP01
  ENST ID: ENST00000611254
  CDS Start-End: 118-1374
ggaggcaacctccaaaaagggaatttcaactttttaaagatacagagaaggatttgccatcaatgtgctgtcagaagataatgcagagagccataaaagcagagctgcaccttttaaatgttcactatcaggaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccaggctaatgaaaaaagaaacacatgtcttttcagaagcagatgctgaacaagataatcagagggctcatgatgttgatgtttcttcaaacctaaaaaagacactctctcaaatgtctttatcatctgacaatagtcatgctacacaaaacatatcacccaagaaagatgactttaaaaatggtgatataaatgcagactttagtcaactgaaacttggtgataaagactgcagacattaccaagagacaagcgaagactggtctgatgctaaagagagcctgacaggagttgacgtctcagggacacagggaaatcaagtagaacaagacacatggaatttggatcttacaggagaaatgaagaatgttgaaccctcacaaagagataaaggttatttgatacatgttggtggcctctgcccttcagtatctgaggccgatttaaggtctcatttccaaaaataccaagtttctgaaatttcaatttatgattctactaattacagatatgcatctcttgcttttacaaaaaacagcgatgcaaagatagctgtgaaagaaatgaatgggatagaaataaatggaaagtcagtaaatgtgtggcctgttaaaattcttggagaatatacatcaccactttcctccaaaaatgggaatagaattagttcgaataatttagagaaaagcaccaacaaacaaatccactcagaattctccatttctagattgcccagaactaggccacggcagctgggttctgagcaagacagtgaggttttcccttccgaccagggtgtcaagaagaattgtaagcagattgaatctgctaaattattacctgatacacccgttcaattcatacctccaaatacattgaaccttcgtagctttaccaagatcataaagagactggctgaactgcatccagaagtcagcagagaccatattataaatgcacttcaggaagtgagaataagacataaaggttttctgaatggcttatctattactactattgtggagatgacttcatctcttctgaaaaactctgcttccagttaggaattcaaaaaacaataaagagaacttccttggaaagtgtgtttcctccttca

SEQ ID NO: 177771 - DNA, 1785 bp, Homo sapiens
  Payload ID: 14882
  Gene Symbol: RBM45
  Gene Name: RNA binding motif protein 45
  Uniprot ID: Q8IUH3
  ENST ID: ENST00000286070
  CDS Start-End: 93-1517
cgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgaacaacaatctgaattttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagatctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaactaaa

SEQ ID NO: 177772 - DNA, 488 bp, Homo sapiens
  Payload ID: 14882
  Gene Symbol: RBM45
  Gene Name: RNA binding motif protein 45
  ENST ID: ENST00000424099
  CDS Start-End: 1-220
atggattgaagagggacaagctcagggtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaactaaa

SEQ ID NO: 177773 - DNA, 2964 bp, Homo sapiens
  Payload ID: 14882
  Gene Symbol: RBM45
  Gene Name: RNA binding motif protein 45
  ENST ID: ENST00000455903
  CDS Start-End: 1-407
cacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagtggccctgaagctgcactatgttggaggtttccttgactaagagaaccacatgcggcattcagctcagtaggggagtcataaaagatctcgcctctgaccagaagagtatgaatgacaaaggtgacataaccagcacagaaagatgtcttagcctctgcacatcagctgatttagaatacttatgtagatagcggttggggtcgggggggtgcggaatgttcttttcagcttctttgccctgagaactttgatcttattgcaaggaagtcccttaccctcttctaccctagatctgatggacctcctgggatttcctggggaaatgaaatgagtctaacacctttgaccacctgctggatattatatcagcacttacttaagtaagctgtggaagagctgaaagcagtattcagagtctgacagttctctgcaattggcctagataaactcattgtgaaataagtaactaaatgggcaaaagatttgaacaagcacttcacaaaagaagaccaagaagagggcagggttttttgtttggggagttttatttagttttgttttggggttgttttgttttggcaggggacaggagtagtggatagattcattttgtaaagaaatattaaaatattctttttaatttgatagttaatataagcttaagaatcttttaaaactcagaatgttcagccgtattagtcatcaatgaactgctcattaaaactacaataagctaccctaacagtggtatgaacagcaagaattaaaatgttgacaataccaagtactggtgacagtgtgaagcaacaagaactgctgatgcaaattggctcaaccgcttgggaaaatgtttgacagtatctactaaagttgaacatatgtataccctcgactcagcaattccacttctaagcatatatccaacaaagatgtgtacatatatgtaccaaaagacacatacaaaaacattcttggtattattcatagtagccccaaagtggaaacaaccccaatgtccatgaacagaatgcatatgacactctatagcaaggaaatgagctaacttgctacacttataatgatttgaaggaatctcacaaacataatgttgaacaaaagcaaccagccaacaaaagatgtgctgtaggattcccagttacagagttcaaaaacaagcaaaacatatctttgagcagaatggaatgggggagttcacaaagggagttatggtgtgctggtggtcttgtttttcttgaccaggatggggataactgatcgtttttgagctgtactctatggagtatgcattttttatttatcttatacttcaattaaagtttttctttcttagtgaataaagcaaaaatcagcatgaggctggtgaaacagacagttctgcagaatgagagaagaacaatgtcctgaagcatttagaaagaaggactttgttcttccagtgcttatagaacaaaaaatattagaaaatatctgcttttgctccccctatggtgcagcagggtattatgatggcaagagggcaggaaaataagagtgagaaaagaaagggagaagctaaattaatatttgagtcagaaatagtaaatagtcatagcactaaagaaaattgaatccatgatgaacagtgaatactgaactacttttcagaatcctgtgggttctcatgagtccacaaagcgaagatggagggaagttcccccactttttgttcattatccagatcagaactgctttcatcaatgttatatattgtgctttaaaagctttcttttaaaggattctctgcagcttaaataagttaggatgaacaaaaagcaccagagcaaaagataaaaagcaccctccgacaaatatagtaagagaaaaggtgcagatcaaaaaggctgattacagagatttatcctttgactaatagatgttcccaataaacaataactcgttttaatagaagaaacatggttgatctaaaaaattttaaaagtcacaagactgaagatcctcttctacacattttaaatgccatctggaatggagcaatgtctgtagttttgtagcccaagattcctctactcatccaaattgtaaaggtaacaggcattctgtgatatacaatgtactgctcatttgccctttctggaaaaaaattaatcaccacactcccaaaatgaatcaaaattaagaataaaagaagaaggaaagaaaggccagtcggtgagtattgaaatcatcactgaaactattagaataatgaaggtaattgtaaatttcattttttaaaaaaagttttattatatgacttatctattccgaaatttttcagtgggatttataaccctaggttaagttaatgaaggccaagaaggaatggcagtttattttttgggggggatggaggtgggtgaggggtaaaatccttctcttttgtaaagaaatattaaaattcattctttttttactttgataattaaatgtaagattaagaatcttttgaagtctgttaaggtgcttaataataaaattaataacagaa

SEQ ID NO: 177774 - DNA, 1788 bp, Homo sapiens
  Payload ID: 14882
  Gene Symbol: RBM45
  Gene Name: RNA binding motif protein 45
  Uniprot ID: Q8IUH3
  ENST ID: ENST00000616198
  CDS Start-End: 93-1523
cgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcagcaagtacacacctgagtcggtgctgagggagcgcttctcgccttttggcgacatccaggacatctgggtggtgcgggacaagcacaccaaggagtccaagggcattgctttcgtcaagttcgcccgcagctcacaggcctgcagggccatggaggagatgcatggccagtgcctcggccccaacgacaccaagcccatcaaggttttcattgctcagtcccgatcatctggaagtcaccgagatgttgaagatgaagaacttacaagaatctttgttatgataccaaagtcctacacagaagaagatctgcgggaaaaatttaaggtgtatggagatatcgagtattgcagcattattaagaataaagtgactggagaaagtaaaggtttgggctacgtacgatacttaaaaccatcacaagctgcccaagcaatagaaaactgtgatcgaagttttagagcaatcttggctgaacctaaaaataaagcatctgaatcctctgaacaagattattatagtaatatgaggcaagaagctttgggacatgaacctagagtaaatatgtttccatttgtcggagaacaacaatctgaattttcaagttttgacaagaatgatagccgaggccaggaagcaatctccaaacgcttgtcagttgtatcaagagttcctttcactgaagaacagcttttcagcatttttgatatagtaccaggattggaatattgtgaagttcaacgagatccttattcaaattatggtcatggagtggttcagtattttaatgtagcatcagctatttatgcaaaatacaaattacatggatttcagtaccctcctgggaaccgaataggtgtttccttcattgatgatggaagtaatgcaacagatctccttagaaaaatggcaacacagatggtagctgcacagcttgcatcaatggtgtggaataacccaagtcagcaacaatttatgcaatttggaggaagctctggatcacagttgcctcaaatccagacagatgttgtacttccatcatgcaaaaaaaaagctcctgctgaaactcctgtgaaagaaagactttttattgtgtttaatcctcatcctttacctttagacgtattagaagatatattctgtcgttttggtaacctgatcgaagtttaccttgtgtcaggaaaaaatgtggggtatgccaagtatgccgatagaataagtgctaatgatgccattgccactctacatggaaagattctgaatggggtgagacttaaagttatgctggcagattcgccaagagaagaatctaacaaacggcaaagaacttactgattcttgagaacaaagactaaataatgacataatcctcagctgactgactgaaaatgtgactggacgcattccctgtggacagttgacagctttttttttttccatatacctgatagtctgtgtacagcattgttttgtctgggaagcagggattgctgacatgtatttttgaatccatacattaatgctaaaacgaatatagtagttgttccttagagcaatatgttgttacgtgtagcagaaataaagttttctttgcttaact

SEQ ID NO: 177775 - DNA, 2583 bp, Homo sapiens
  Payload ID: 14883
  Gene Symbol: RBM46
  Gene Name: RNA binding motif protein 46
  Uniprot ID: Q8TBY0
  ENST ID: ENST00000281722
  CDS Start-End: 236-1837
gattggatgaggcaccactcctcgtggggctgcttaggccaccgcgcgcgctgcgcgctgggaaacgagtggagacacgaggaccagcgcgagcggtcccggtgggctaccctccccctgcgacgaccccccctcgctctgaccgactggtcccctaaacggtggcggcggtttttggtcgttgggccccgggatttaggaccaacatttgaagacccgaaggggaactgcaaccatgaatgaagaaaatatagatggaacaaatggatgcagtaaagttcgaactggtattcagaatgaagcagcattacttgctttgatggaaaagactggttacaacatggttcaggaaaatggacaaaggaaatttggcggtcctcctccaggttgggaaggtccacctccacctagaggctgtgaagtttttgtaggaaaaatacctcgtgatatgtatgaagatgagttagttcctgtatttgaaagagctgggaagatatatgaatttcgacttatgatggaatttagtggtgaaaatcgaggttatgcttttgtgatgtacactacaaaagaagaagcccaattagccatcagaattcttaataattatgaaattcgaccagggaagtttattggtgtgtgtgtaagcctggataattgtagattatttattggagctattcccaaggaaaagaagaaagaagaaattttagatgaaatgaagaaagttacagaaggagttgtagatgtcattgtttatccaagtgcaactgataagaccaaaaatcgtggttttgcatttgtggaatatgaatctcacagagctgctgctatggcaaggaggaaactaattccaggaacattccaactatggggccacaccattcaggtagattgggctgacccagagaaagaggtggatgaggaaaccatgcagagagttaaagttctttatgtaagaaatttaatgatctcaactacagaggaaacaattaaagcagaattcaataaatttaagcctggtgcagttgaacgggtaaagaaacttagagattatgcttttgttcactttttcaaccgagaagatgcagtggctgccatgtctgttatgaatggaaaatgcattgatggagcaagtattgaggtaacactagctaaaccagtaaataaagaaaacacttggagacagcatcttaatggtcagattagtccaaattctgaaaatctgattgtgtttgctaacaaagaagagagccacccaaaaactctaggcaagctgccaactcttcctgctcgtctcaatggtcagcatagcccaagtccgcctgaagttgaaagatgcacttaccctttttatcctggaacaaagcttactccaattagtatgtattctttaaaatccaatcattttaattctgcagtaatgcatttggattattactgcaacaaaaataactgggcaccaccagaatattatttatattcaacaacaagtcaagatgggaaagtactcttggtgtataagatagttattcctgctattgcaaatggatcccagagttacttcatgccagacaaactctgtactacgttagaagatgcaaaggaactggcagcccagtttacattacttcatttggactacaatttccatcgcagctcaataaatagtctttcccctgttagtgctaccctctcttctgggactcccagcgtgcttccttatacttcaaggccttattcttatccaggctatcctttgtcaccaacaatatcacttgctaatggcagccatgttggacagcggctatgtatctccaatcaggcctccttcttctgaagaaaatactaacattagtatgaaaatttgtgtaaatttgtagtatgaaaacttgcaaattaaaatattgttttattttagaatcgggtttgcatatttggttttaaaaaggtatttattccaaagtactaaacatcagctataattcagaataacatggagttgtagaatttataaaaatgcaaagtttaaaaagttattcagtggtttctcttgataaaggtacagcaaactactattctttttaaacttctaggattttcttctactttctgagtgggcaatagaacctagtcatttatgtttttttttttttttgcataattttactaaatagtatttcacaaatattaaagcacttgaagacaatggttatagtagatttgattaccaaggatcactatctgtactggagattagaacaattatatgaccagaagcatctaaccattatgtaaaaagaaatgatgagacaaaaagattaagatacaaattttgtgcagtactaaagaaaaagcagtctaccattgtggtccttgaaaataactatagatatttttgttatttgttagacacaaattataattttgttgttaatgtatttaagcattttatagttatgctttgtgtttttgatattctttgtattgttaataacaagtgttatgggtttttaatgttgaaatcatgtgttaatttttgtacttgaattcaaattttttgacattaaatatgtgatgcttcta

SEQ ID NO: 177776 - DNA, 3626 bp, Homo sapiens
  Payload ID: 14883
  Gene Symbol: RBM46
  Gene Name: RNA binding motif protein 46
  Uniprot ID: Q8TBY0
  ENST ID: ENST00000510397
  CDS Start-End: 180-1592
actctcacgccgaatacacagtgggggctggcggcggtggctgcggggttcaccctcgtccttccccagccccgtcgagcagtgggagggcaagtgtccgagacgctgcttcctgccccggcagcatccggccagaaggcgccctcgccgtcacccaggcgctgcatggaactgcaaccatgaatgaagaaaatatagatggaacaaatggatgcagtaaagttcgaactggtattcagaatgaagcagcattacttgctttgatggaaaagactggttacaacatggttcaggaaaatggacaaaggaaatttggcggtcctcctccaggttgggaaggtccacctccacctagaggctgtgaagtttttgtaggaaaaatacctcgtgatatgtatgaagatgagttagttcctgtatttgaaagagctgggaagatatatgaatttcgacttatgatggaatttagtggtgaaaatcgaggttatgcttttgtgatgtacactacaaaagaagaagcccaattagccatcagaattcttaataattatgaaattcgaccagggaagtttattggtgtgtgtgtaagcctggataattgtagattatttattggagctattcccaaggaaaagaagaaagaagaaattttagatgaaatgaagaaagttacagaaggagttgtagatgtcattgtttatccaagtgcaactgataagaccaaaaatcgtggttttgcatttgtggaatatgaatctcacagagctgctgctatggcaaggaggaaactaattccaggaacattccaactatggggccacaccattcaggtagattgggctgacccagagaaagaggtggatgaggaaaccatgcagagagttaaagttctttatgtaagaaatttaatgatctcaactacagaggaaacaattaaagcagaattcaataaatttaagcctggtgcagttgaacgggtaaagaaacttagagattatgcttttgttcactttttcaaccgagaagatgcagtggctgccatgtctgttatgaatggaaaatgcattgatggagcaagtattgaggtaacactagctaaaccagtaaataaagaaaacacttggagacagcatcttaatggtcagattagtccaaattctgaaaatctgattgtgtttgctaacaaagaagagagccacccaaaaactctaggcaagctgccaactcttcctgctcgtctcaatggtcagcatagcccaagtccgcctgaagttgaaagatgcacttaccctttttatcctggaacaaagcttactccaattagtatgtattctttaaaatccaatcattttaattctgcagtaatgcatttggattattactgcaacaaaaataactgggcaccaccagaatattatttatattcaacaacaagtcaagatgggaaagtactcttggtgtataagatagttattcctgctattgcaaatggatcccagagttacttcatgccagacaaactctgtactacgttagaagatgcaaaggaactggcagcccagtttacattacttcatttgggtcctttctgatgttgcttgagcttactctcctgcagttgatctcattcctgttggctaaacattaagtcccatgacaacattaagttaatgcacctatggtgtaggcatcatttatagtaccaggacagtattatagaaaaaaaccttacctgtacattagatgacctaatttcttttcttccattcctagaaacaccataatgtttctaaataatgattttatagtcattgtcacacccttggcttattttacactaaagaacatagttgagtttttggaaggtacaggatttaaaaatttggtctgtaatatacacacacacatataaatgttgcagttaatgaaacaggaaattattgatgcataagatgaatgtttattgtgaaacagtatttcaaatgttattttttaataatttggtttaattggatatttttctgtactataagttgataatggttttttgaagtaactataagttgataatggttttttgaagtttatttaataaaggtgattcattatactgttttatcataccagtaggacttttaatgttaaatcagtatgttgagttagataagtgtttatattagtatttaaataatgaaatattggccagctagtttataccaaatgtttttgcagtccaggggtgaatgtttctgctggtttgatgcctaatacagcttcaaagaaaaaaaaaaagcaaatatgaattcactgttttttatcttttcttcatggactaccccttagaaccaaatttaaaagaagcttctttgtagagcaagagaaatgagacgttctctttttctataatcaaaactccaagaaatagtagatatccaagaattcattctggtaagatctctgaaacattgcgtgagtaaaggaaaggtaatactgacaaaactctcaggatttgcagtgcagtgaatgctgaaataatctttaaccagcaatatagtatcatcaagatttccagtgttagaacattatgttaaaatgtgattattgtttaatgctttgtctctttaaattaaatttgtgtccataaagatgtacagcataattgttcatgtatttatttacagactacaatttccatcgcagctcaataaatagtctttcccctgttagtgctaccctctcttctgggactcccagcgtgcttccttatacttcaaggccttattcttatccaggctatcctttgtcaccaacaatatcacttgctaatggcagccatgttggacagcggctatgtatctccaatcaggcctccttcttctgaagaaaatactaacattagtatgaaaatttgtgtaaatttgtagtatgaaaacttgcaaattaaaatattgttttattttagaatcgggtttgcatatttggttttaaaaaggtatttattccaaagtactaaacatcagctataattcagaataacatggagttgtagaatttataaaaatgcaaagtttaaaaagttattcagtggtttctcttgataaaggtacagcaaactactattctttttaaacttctaggattttcttctactttctgagtgggcaatagaacctagtcatttatgtttttttttttttttgcataattttactaaatagtatttcacaaatattaaagcacttgaagacaatggttatagtagatttgattaccaaggatcactatctgtactggagattagaacaattatatgaccagaagcatctaaccattatgtaaaaagaaatgatgagacaaaaagattaagatacaaattttgtgcagtactaaagaaaaagcagtctaccattgtggtccttgaaaataactatagatatttttgttatttgttagacacaaattataattttgttgttaatgtatttaagcattttatagttatgctttgtgtttttgatattctttgtattgttaataacaagtgttatgggtttttaatgttgaaatcatgtgttaatttttgtacttgaattcaaattttttgacattaaatatgtgatgcttct

SEQ ID NO: 177777 - DNA, 2315 bp, Homo sapiens
  Payload ID: 14883
  Gene Symbol: RBM46
  Gene Name: RNA binding motif protein 46
  Uniprot ID: Q8TBY0
  ENST ID: ENST00000514866
  CDS Start-End: 236-1693
gattggatgaggcaccactcctcgtggggctgcttaggccaccgcgcgcgctgcgcgctgggaaacgagtggagacacgaggaccagcgcgagcggtcccggtgggctaccctccccctgcgacgaccccccctcgctctgaccgactggtcccctaaacggtggcggcggtttttggtcgttgggccccgggatttaggaccaacatttgaagacccgaaggggaactgcaaccatgaatgaagaaaatatagatggaacaaatggatgcagtaaagttcgaactggtattcagaatgaagcagcattacttgctttgatggaaaagactggttacaacatggttcaggaaaatggacaaaggaaatttggcggtcctcctccaggttgggaaggtccacctccacctagaggctgtgaagtttttgtaggaaaaatacctcgtgatatgtatgaagatgagttagttcctgtatttgaaagagctgggaagatatatgaatttcgacttatgatggaatttagtggtgaaaatcgaggttatgcttttgtgatgtacactacaaaagaagaagcccaattagccatcagaattcttaataattatgaaattcgaccagggaagtttattggtgtgtgtgtaagcctggataattgtagattatttattggagctattcccaaggaaaagaagaaagaagaaattttagatgaaatgaagaaagttacagaaggagttgtagatgtcattgtttatccaagtgcaactgataagaccaaaaatcgtggttttgcatttgtggaatatgaatctcacagagctgctgctatggcaaggaggaaactaattccaggaacattccaactatggggccacaccattcaggtagattgggctgacccagagaaagaggtggatgaggaaaccatgcagagagttaaagttctttatgtaagaaatttaatgatctcaactacagaggaaacaattaaagcagaattcaataaatttaagcctggtgcagttgaacgggtaaagaaacttagagattatgcttttgttcactttttcaaccgagaagatgcagtggctgccatgtctgttatgaatggaaaatgcattgatggagcaagtattgaggtaacactagctaaaccagtaaataaagaaaacacttggagacagcatcttaatggtcagattagtccaaattctgaaaatctgattgtgtttgctaacaaagaagagagccacccaaaaactctaggcaagctgccaactcttcctgctcgtctcaatggtcagcatagcccaagtccgcctgaagttgaaagatgcacttaccctttttatcctggaacaaagcttactccaattagtatgtattctttaaaatccaatcattttaattctgcagtaatgcatttggattattactgcaacaaaaataactgggcaccaccagaatattatttatattcaacaacaagtcaagatgggaaagtactcttggtgtataagatagttattcctgctattgcaaatggatcccagagttacttcatgccagacaaactctgtactacgttagaagatgcaaaggaactggcagcccagtttacattacttcatttggacagggaacacaatctcttcagcctggacctgtgtagaagaatttggagaaaataaacaggtcctttctgatgttgcttgagcttactctcctgcagttgatctcattcctgttggctaaacattaagtcccatgacaacattaagttaatgcacctatggtgtaggcatcatttatagtaccaggacagtattatagaaaaaaaccttacctgtacattagatgacctaatttcttttcttccattcctagaaacaccataatgtttctaaataatgattttatagtcattgtcacacccttggcttattttacactaaagaacatagttgagtttttggaaggtacaggatttaaaaatttggtctgtaatatacacacacacatataaatgttgcagttaatgaaacaggaaattattgatgcataagatgaatgtttattgtgaaacagtatttcaaatgttattttttaataatttggtttaattggatatttttctgtactataagttgataatggttttttgaagtaactataagttgataatggttttttgaagtttatttaataaaggtgattcattatactgttttatcataccagtaggacttttaatgttaaatcagtatgttgagttagataagtgtttatattagtatttaaataatgaaatat

SEQ ID NO: 177778 - DNA, 526 bp, Homo sapiens
  Payload ID: 14883
  Gene Symbol: RBM46
  Gene Name: RNA binding motif protein 46
  ENST ID: ENST00000512640
  CDS Start-End: 128-526
acacgcttacgccgacgaccaacgaccgctgcaggcccgggccgctgcctggccgttgtagggtccgcgcgtcccctggaggctttggacgccgtctggggcgtcccgacggctgggaactgcaaccatgaatgaagaaaatatagatggaacaaatggatgcagtaaagttcgaactggtattcagaatgaagcagcattacttgctttgatggaaaagactggttacaacatggttcaggaaaatggacaaaggaaatttggcggtcctcctccaggttgggaaggtccacctccacctagaggctgtgaagtttttgtaggaaaaatacctcgtgatatgtatgaagatgagttagttcctgtatttgaaagagctgggaagatatatgaatttcgacttatgatggaatttagtggtgaaaatcgaggttatgcttttgtgatgtacactacaaaagaagaagcccaattagccatcagaattcttaataattatgaaattcgaccagggaagtttattggt

SEQ ID NO: 177779 - DNA, 4056 bp, Homo sapiens
  Payload ID: 14884
  Gene Symbol: RBM47
  Gene Name: RNA binding motif protein 47
  Uniprot ID: A0AV96
  ENST ID: ENST00000295971
  CDS Start-End: 709-2490
agactagacgctgagcgctcccgtgcgcagcgccccacgcagccgggacgcggcgccgctctgcgggtggaaccgccgcgcgctcccggcctcgggagctgagcccgagagaacttcgctgccttcgggtcgccgctcccgctttccactgtggaatgtgcagcttgggatagagagaaaccagggtttggggagcggtcctcctggagactttctctctgcaagtctccaaggttaagcaattctgacccactggaattcccagagcctgggagttaagcctaaaacgctctgttgctttaagcggcgcggtggggagtcgctggacactccttattttggttttacattaaaaagaaggcggacgagaagatgttgtaggtgacttcctagctgtgttaagttgctcctgggctgtgaatggtgttaatttctgaagtgggcggctccaaaaacttaacaaggaaagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggtcgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaa

SEQ ID NO: 177780 - DNA, 4816 bp, Homo sapiens
  Payload ID: 14884
  Gene Symbol: RBM47
  Gene Name: RNA binding motif protein 47
  Uniprot ID: A0AV96
  ENST ID: ENST00000381793
  CDS Start-End: 398-2179
aaggggaagtgtggaaatagagcctgcttgttcattttcattattgtacattacatgatatcttttcgaccattatattgtgttccctcagtggtgtttgctctgagggtgggacacaagcctgtttagtgtctcgtaaaacatttaccaaaagcactgagccatggtttttgaagggcattccgttgccagagtgtgggaggagagagcaagcagggaaagagagcgccaggtgcttagcaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggtcgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagacctta

SEQ ID NO: 177781 - DNA, 4473 bp, Homo sapiens
  Payload ID: 14884
  Gene Symbol: RBM47
  Gene Name: RNA binding motif protein 47
  Uniprot ID: A0AV96
  ENST ID: ENST00000381795
  CDS Start-End: 262-1836
agtcagacccaggaggagtgaggtcaattgccctttagtcccaggactaaccggaagcttctgcaacaggaggacattgaaaataagatggaacccatccacataaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaagtatcagtgagcctcctatctgggacttatctgttcctattgtttcaaaaccatttcatgtacactactgaggtaagtttataacttgaaatgtgaactttttttttttttagtgttaagaacaaactatataaatgtaaaaaaaaagttttagagttctgttttcaaacattgctagtggtttagttaactttagctgctttatatttgaaaagcttttatttagatcttgctccatttacagtacattcttaggatgtatgtagtaaataaagctttctttaaagcaatcgcaagacctta

SEQ ID NO: 177782 - DNA, 882 bp, Homo sapiens
  Payload ID: 14884
  Gene Symbol: RBM47
  Gene Name: RNA binding motif protein 47
  ENST ID: ENST00000513473
  CDS Start-End: 304-882
gggaaagagagcgccaggtgcttagcaggatttgcctcaaagggcactgcaaaaattgaacagaggaatcccaaggaagctgcctgaatttgcctgtatactctcgttctgcgacttataaaggaccagacaaatcaaattagtggttttgagacagggtctcactatgttgcccagactggtctggaactcctgagctcaagcaagcttctcacctcagcctcccaaagtgctgggattataggcttcagccaccacgcccaaccagccaggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaac

SEQ ID NO: 177783 - DNA, 1100 bp, Homo sapiens
  Payload ID: 14884
  Gene Symbol: RBM47
  Gene Name: RNA binding motif protein 47
  ENST ID: ENST00000515053
  CDS Start-End: 449-1100
taatttctccaacgtggttctggctgggtttctcggagcagcccgaagggggccgagcgtctgactcggacagatgcccccaggtggagcaggtgccacttctgggtgtctgaaaggcatgtgacttttggggcggggagagaagtccgtctggtcaagtcccccaatctctgccatcaaggccgattttctttgaaccttcagcaaagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggcc

SEQ ID NO: 177784 - DNA, 4951 bp, Homo sapiens
  Payload ID: 14884
  Gene Symbol: RBM47
  Gene Name: RNA binding motif protein 47
  ENST ID: ENST00000510871
  CDS Start-End: 709-1890
agactagacgctgagcgctcccgtgcgcagcgccccacgcagccgggacgcggcgccgctctgcgggtggaaccgccgcgcgctcccggcctcgggagctgagcccgagagaacttcgctgccttcgggtcgccgctcccgctttccactgtggaatgtgcagcttgggatagagagaaaccagggtttggggagcggtcctcctggagactttctctctgcaagtctccaaggttaagcaattctgacccactggaattcccagagcctgggagttaagcctaaaacgctctgttgctttaagcggcgcggtggggagtcgctggacactccttattttggttttacattaaaaagaaggcggacgagaagatgttgtaggtgacttcctagctgtgttaagttgctcctgggctgtgaatggtgttaatttctgaagtgggcggctccaaaaacttaacaaggaaagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagatacaatcctagaaactcaccctgcaagtttgcctcttgtactaagaagacatgcttaggatgcaaatctaggctgaaatagaatgttggaagcatctttaccagcctattaaagagcaaaggtgtagccacctgcaattaagactggggcagttaaatgccgagaaccgagggctgaggtctgcctccagcaccgtcactgttggttgctgatcatcttttgtgttgttattacaagcaggcagcataagaggccgagggcgaggtgcagctggcaacagagccccagggcctaggggttcctacctcgggggatattctgctggtcgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaagcattattttaaaggttatactggaaagtgcaattttaaaatgagtaaaacctctgtatttctgctggcattaagggttgatggtgttaccatgtatcatcatggcggtactattttttaaaagaaattaaacactggatctctccttaagccaacattgaaaagacttgccgcacttctgagtccaaacactggaaagctctcctttgccaccgttagccggggctcattctccatgtgccttagccttaaacatgcccccactcccacatctctcaccctgtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaataattgtgcaatgttcctgatgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaa

SEQ ID NO: 177785 - DNA, 2419 bp, Homo sapiens
  Payload ID: 14884
  Gene Symbol: RBM47
  Gene Name: RNA binding motif protein 47
  ENST ID: ENST00000514014
  CDS Start-End: 260-1927
agaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaagagactctgcgtcaggtcacccagcagagatcagcaatccttggctcactgaggaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccccaagatgaagaagcgcgaggaaatcctggaggagattgccaaggtcaccgagggcgtgctggacgtgatcgtctacgccagcgcggccgacaagatgaagaaccgcggcttcgccttcgtggagtacgagagccaccgcgcggctgccatggctcgccgcaagctcatgcctggccgcatccagctgtggggccaccagatcgccgtggactgggccgaacctgagatcgacgtggacgaggacgtgatggagaccgtgaagatcctctacgtgcgcaacctcatgatcgagaccaccgaggacaccatcaagaagagcttcggccagttcaaccccggctgcgtggagcgcgtcaagaagatccgcgactacgccttcgtgcacttcaccagccgcgaggatgccgtgcatgccatgaacaacctcaacggcactgagctggagggctcgtgcctggaggtcacgctggccaagcccgtggacaaggagcagtactcgcgctaccagaaggcagccaggggcggcggcgcggctgaggcagcgcagcagcccagctacgtgtactcctgcgacccctacacactggcctactacggctacccctacaacgcgctcattgggcccaacagggactactttgtgaaagcaggcagcataagaggccgagggcgaggtgcagctggcaacagagccccagggcctaggggttcctacctcgggggatattctgctggtcgtggtatatatagccgatatcatgaagggaaaggaaagcagcaagaaaaaggatatgaactggtgccgaatttggaaatccctaccgtcaacccagttgccattaaacctggtacagtagccatccctgccattggggctcagtattccatgtttccagcagctccagcccctaaaatgattgaagatggcaaaatccacacagtggagcacatgatcagccccattgctgtgcagccagacccagccagtgctgctgccgccgcagccgcggccgcagccgccgcagccgctgtcattcccactgtgtcgacgccaccacctttccagggccgcccaataactccagtatacacggtggctccaaacgttcagagaattcctactgccgggatctacggggccagttacgtgccatttgctgctccagctacagccacgatcgccacactacagaagaacgcggcagccgcggccgccatgtatggaggatacgcaggctacatacctcaggccttccctgctgctgccattcaggtccccatccccgacgtctaccagacatactgaggctggtgaccagcacgaagacagaccacacaaacaccactgaaggaacgcttgactatttatgaagaaggaacatgttggattcacacatgcaacctgaaagtgaagaatgttagcagatttatttctgaattattttatatacatgaagttttcactagttttttaagactattttcaacttagcatgcctacgttcatacatttccaaaagacttgcaatggttcgtgccttcattccatcttttaaaaatttgtatgctgtactacatttgtatagaggtttttgttgttgtttttttaaggatatattttcagtatgaaggttattttcttaacttctgcactccagagatttctattttgtagtaccttcaataatatatcaactatatattaaaaaagcacacttgaggagctagggaactattttgaaaaatatatacaatatttaaagatacaaacagtagtgcttaaaaatactacataaag

SEQ ID NO: 177786 - DNA, 582 bp, Homo sapiens
  Payload ID: 14884
  Gene Symbol: RBM47
  Gene Name: RNA binding motif protein 47
  ENST ID: ENST00000507180
  CDS Start-End: 212-582
gcttaagcaaagctttcattacagttagcctgtcgcacccagatcaagattggaaaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggc

SEQ ID NO: 177787 - DNA, 856 bp, Homo sapiens
  Payload ID: 14884
  Gene Symbol: RBM47
  Gene Name: RNA binding motif protein 47
  ENST ID: ENST00000505414
  CDS Start-End: 381-856
ccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcccgggccgcctgctcggcgtgtgctgcagcgtggacaactgccgcctcttcatcggcgggatccc

SEQ ID NO: 177788 - DNA, 836 bp, Homo sapiens
  Payload ID: 14884
  Gene Symbol: RBM47
  Gene Name: RNA binding motif protein 47
  ENST ID: ENST00000511598
  CDS Start-End: 496-836
gtcacagaattcgattcctgttggcccattccgcgcctacaaacaggcttagcgctccactgaaatgcgggaggctccttaactcttgtataaacagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgc

SEQ ID NO: 177789 - DNA, 657 bp, Homo sapiens
  Payload ID: 14884
  Gene Symbol: RBM47
  Gene Name: RNA binding motif protein 47
  ENST ID: ENST00000511902
  CDS Start-End: 479-656
ataaacaggtaaggcggagggggtggggcgcggattgcggacatctgggtttcttgggaattgggatggggtgggggttcgagccaactccccagagagcaggcaaggtgaagcgagggcttggctgctgtttctaaatgcagtgtttttttgttccctttctagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccaggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcc

SEQ ID NO: 177790 - DNA, 741 bp, Homo sapiens
  Payload ID: 14884
  Gene Symbol: RBM47
  Gene Name: RNA binding motif protein 47
  ENST ID: ENST00000505220
  CDS Start-End: 564-741
ataaacaggtaaggcggagggggtggggcgcggattgcggacatctgggtttcttgggaattgggatggggtgggggttcgagccaactccccagagagcaggcaaggtgaagcgagggcttggctgctgtttctaaatgcagtgtttttttgttccctttctagaaaccctccgtaactctaggtcagagcgcactaaaatgagccacttctgaacgagcagcgcccaggccccaggccctgctgcgaaggccccggcaaaggtcagggccccgtccgcgtgacgctcctgcctgcgcgcggccaagccatgctcggccccagctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgc

SEQ ID NO: 177791 - DNA, 797 bp, Homo sapiens
  Payload ID: 14884
  Gene Symbol: RBM47
  Gene Name: RNA binding motif protein 47
  ENST ID: ENST00000514782
  CDS Start-End: 386-797
tgaaccttcagcaaaggtatctgcgctcctaaaaaacaacaggaatgtggcactggcctttagccaggggaggctcagccagcaggataaaatttcagggcagatttacgggaagttgccggtgttgggagtaaaaatctggtttgctcaggtaacggaggccttggaaagagactctgcgtcaggtcacccagcagagatcagcaatccttggctcactgaggaggtttggatttgcctcaaagggcactgcaaaaattgaacagaggaatcccaaggaagctgcctgaatttgcctgtatactctcgttctgcgacttataaaggaccagacaaatcaaattagtggttttggtttccgccagctgtggatgcctttgacattatgaccgcagaggattccaccgcagccatgagcagtgactcggccgccgggtcctccgccaaggtgcccgagggcgtggcgggcgcgcccaacgaggcagcactgctggcgctgatggagcgcacgggctacagcatggtgcaagagaacgggcagcgcaagtacggcggcccaccgcccggctgggagggcccgcacccgcagcgtggctgcgaggtcttcgtgggcaagatcccgcgcgacgtgtacgaggacgagctggtgcccgtgttcgaggccgtgggccgcatctacgagctgcgcctcatgatggactttgacggcaagaaccgcggctacgccttcgtcatgtactgccacaagcacgaggccaagcgcgcagtgcgtgagctcaacaactacgagatccgcc

SEQ ID NO: 177792 - DNA, 1742 bp, Homo sapiens
  Payload ID: 14885
  Gene Symbol: RBM48
  Gene Name: RNA binding motif protein 48
  Uniprot ID: Q5RL73
  ENST ID: ENST00000265732
  CDS Start-End: 42-1145
gggcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattataatacaa

SEQ ID NO: 177793 - DNA, 715 bp, Homo sapiens
  Payload ID: 14885
  Gene Symbol: RBM48
  Gene Name: RNA binding motif protein 48
  ENST ID: ENST00000496410
  CDS Start-End: 441-715
aggcaagatggcgtcgagcggcggggagctagggagtttatttgatcaccacgtccagagggcggtatgcgacacacgggccaaatatcgagagggacgacggcctcgtgctgtgaaggtaaagtgattttggtttcattcgctctcctcggtagctttatgtgagtgctagcgccatatgaccagcctacggaaataaaggcacgacaaggcttccgtcagatctgtctctcgttagagctggcgtgaagaaccctcggtcagttaccaaagattctcacgacgcctttggtcaagtattagaacatcaactccacgagaataggccttggttttagtcattggatcttctgtgtttacagtactacttggcacaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagg

SEQ ID NO: 177794 - DNA, 4093 bp, Homo sapiens
  Payload ID: 14885
  Gene Symbol: RBM48
  Gene Name: RNA binding motif protein 48
  Uniprot ID: Q5RL73
  ENST ID: ENST00000481551
  CDS Start-End: 42-1172
gggcggatgttgtcctccctgcgaggatcaaagtaggcaagatggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaaggttatttttaaaaaactattctaagacacgatttggttataggattaaatggagaattatttgtgggaacaatagtactgtaattttttttcactttttagtgttttgatgtgtttttctacagttctctgttgaaataactgaatttggctaacattttatttgctttaaactgttaatacttgctttaaacaatgaacagacattttatatcactgtagatacaaaatattaaagcagtggtttcagccaattaaatcaatctgtgagagtggagcccaggcctgccatttttgttaaaagctccccaggtagttctaatatgagccaaagttgagaagcaaaagtattgtaaattatttctctcaaatttagagttattacagtttatatcaaattcaaaatgcttaatttgcttttgtgataaagagcaatagaaggtggtgagatttctaaaaattaggcctccaggtatgcatttcaaatgtagacttcttaaatgatcgggatcagattgtgctgcctaggtagtctgtttttttttttaatgtcatttacataatcattttccatttcctaagcacaaatgaagttaacatctgagttagcttttgaaagacacctttttgtggggtagggactactgttacaaatcataaactgagggttatgacattctcttatacttactccaagatgcagaaactgcttttcacatagttttactcatattttacaatgtgattaagggaggctaaggtagtttaatttcatatatgtacattttttacctaaaaatatctgattaaaggtattatttaataataattaaaatccgtgggcacagttttgaagccttctttagcttttcagtttaggctgggcccagtgcctcacaccaataacttcagcactttgggaggctgaggtgagcagattgcttgagcccaggagtctgagaccagcctgaccaatgtgatgaaaccccatctttaccataaatatacaaaaattagccaggcgtggtggtgaactcttgtagctacttgggaagcttaggtggaagggtacttgagtctgggaggcggaggttgcagtgagccaagatcatgccactgcactccagcctgggtgacagtgtgagaccctgtctcaaaaaaaaaggttttcagtttgtgctgccacccttacttccttccttcagttacagctgaactgaggcatagacatagatacatacctgtctcaaccagagctgattacattttcaagataaacgtgtgaagtccaaattctaggtccagaaatagaacaacaaaaaaaagatattaaatacagtttactatagtttctaataattttccatttcaaatgaagactcttactttgctttgacttattgtatactctttgtacactctttttctgatggtgtgtttgcttttcctttttctccaggaaattgaggattatactgcttcctgctcatttctccaaaggttttcatccccccaaatctatcaaacgttatcagtgtttcaagaatgcaaaaccaggatatctatctgaatccgtaatataacaagtgtctttagatctataaaggaatgttaaagtagagcatatgttcacttttcttcctccaaattttttttctttttaaatagctttagaaattttactgtcatcagtattcaaatggaagactccactctgtgcctaggtcataggctgtaccttgaacttaggcgaactctgcctcgaaagtgacatcaaggattgaactattggatgtagtcttacctcttctaatagcttatttactcctgtgctatagaaactaagttttaatggttcttttttttttttaattaggtaatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagccatttgtctaaagtcatttctttgttttttgggagatggagtcttgctctgttgcccaggctggaatgcagtggcgtgatctcggctcactgcaacctccacctcccgggttcaagcgattctcctgcctcagcctcctgagtatctgggattacaggcgtgcaccaccatgcctggctaagttttgtgttttttttagtagagatgggttttcaccatattggtcaggctggtctcgaactcctgaccttgtgatacacctgcctcagcctcccaaagggatgagccaccgcgcctggcccatttcttctttttttgacccatacttaatgttgcagaaactattcttgtcataacattatctctcatgtacagtaattatatgtaaattaattgaagcaaatatggaaactttacaatagaaataaagataggcagccagcgtctgtttccaattataatacaagtattgaatgaaccattgaaacactagaagtcaggatgtttccgaatgccagggtttcaaaatcaagacaattctatgaagtaaaaagtagattagctattagaacaaagctgaaattagaaccttatatgctttaaataacttttaagaatttgcttgacctgtggcaatccaaaaatacatcagtatttataaattctagacttctgttactacttctggcatatccacacttttttctgtcagtggattacataattggaaatttcagtacatctagactgtctctattttctttttctttttttatttttagtagagacagggtctcactgtgttgcccaggcaggtattgaactcctgggctcaagtgattcacccacctcggcctcccaaagtactaggattatgggtgtgacccactgtgcctggccattttctttactgataaaaataacttgagaaggtcca

SEQ ID NO: 177795 - DNA, 1236 bp, Homo sapiens
  Payload ID: 14885
  Gene Symbol: RBM48
  Gene Name: RNA binding motif protein 48
  ENST ID: ENST00000617438
  CDS Start-End: 1-1083
atggcgtcgagcggcggggagctagggagtttatttgatcaccacgtccagagggcggtatgcgacacacgggccaaatatcgagagggacgacggcctcgtgctgtgaaggtatatacaatcaatttggaatctcagtacttattaatacaaggagttcctgctgtgggagtcatgaaggaattagttgagcgattcgctttatatggtgcaattgaacagtacaatgctctagatgaatacccagcagaagactttactgaagtttatcttattaaatttatgaacttacaaagtgcaaggacagccaagagaaaaatggatgaacagagtttcttcggtggattgcttcatgtgtgctatgctccagaatttgaaacagttgaagaaactagaaaaaaactacaaatgcggaaggcatatgtagtaaaaactactgaaaataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtatttcatctgtgccaaagcctccagaggacaagccagaagatgtacatacaagtcatccattaaaacaaagaagaagaatatagagtgccagcagcaacttagtattttctaaaaagaacatttattatttatttttagcctgtcattttaattcttcaagagattttactgctggtattttttaatgcactcctctttgtaatttcattcaagcca

SEQ ID NO: 177796 - DNA, 1840 bp, Homo sapiens
  Payload ID: 14886
  Gene Symbol: RBM4B
  Gene Name: RNA binding motif protein 4B
  Uniprot ID: Q9BQ04
  ENST ID: ENST00000310046
  CDS Start-End: 171-1250
ggctcccgcgaggggaaggggagggaagcagcgcgcactcgcgcgtgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaa

SEQ ID NO: 177797 - DNA, 2339 bp, Homo sapiens
  Payload ID: 14886
  Gene Symbol: RBM4B
  Gene Name: RNA binding motif protein 4B
  Uniprot ID: Q9BQ04
  ENST ID: ENST00000525754
  CDS Start-End: 670-1749
gtgtgtgtgatgtggggagctcgggggcgggtcgggccgggcctccggcagactgcacggcccggatttgggtttctcattttgcagcgggaggtctgggaagacaacgggaggaggcggggccgggtctccggaaggaggcggggcaggggtcgggtcgagtctttgttggggcgaagaagctggagggtgggccgctgggggcgaggtggttggtccccggtttgggggaaaggggacttttttctttttagagtatcttgaaaggcgctagtgcgcgcaggagaggtacacagatttccctccaaaaccttgttaccaggcgcactgcgattgatgccccttgcctttgcttgggcttttctcttccctcattttaagacatgaagcagctaattctggtatttcattgcgctccacttcacggagatgatagactgggctatgcatgctgaccctcgacctcctgtttgcatgtcacgcatagctcgcacttctcgagaacaaaccgcccttcttctattgaggaagaataatgaatgtctgtacgagggtcttgaaggtgcaagaactttggaggattagacgaaaatgctgcagtgcaccgaaatttcccaccacacccctgacttttgaagtcttgtgtttctctcccaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcagagcagaccatgtcccatctgcctcaagtccaaagcacaactgtgaccagccacctcaactctacttctgttgatccctatgacagacacctattgccaaactctggcgctgctgccacttcagctgctatggctgctgctgcagccaccacttcctcctactatggaagggacaggagcccactgcgtcgtgctgcagccatgctccccacagttggagagggctacggttatgggccagagagtgaattatctcaggcttccgcagctacacggaattctctgtatgacatggcccggtatgaacgggagcagtatgtggaccgagcccggtactcagccttttaaaaactggaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctcttatcttgctttccctaggagttgaatccttctccctgcctacctgcagcatctcctttccctttaaaatgaccatgtagtggcaagcagccttttactcttctgttagctctggactcttaacacttaagttactcttctgaaattgctaggaccattgggggttttgttgttttgtttgttttttatgtccgacctgtgatcgtggtacagcattagctgaaatttacccttgttttactccactcctcccttttttaaaaaaattttttgacaaataaatgtttctaacacttaaa

SEQ ID NO: 177798 - DNA, 867 bp, Homo sapiens
  Payload ID: 14886
  Gene Symbol: RBM4B
  Gene Name: RNA binding motif protein 4B
  ENST ID: ENST00000524637
  CDS Start-End: 87-530
aggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggatggtggagcacaaggcttcctctcgcatagctgcatccagaagaaggcaaaagaatgcatgtgcagttgtccacaagccggcttcggactgcccctggtatgggagaccagagtggctgctatcggtgtgggaaagaagggcactggtccaaagagtgcccagtagatcgtacgggtcgtgtggcagactttactgagcagtataatgaacaatatggagcagttcgaacaccttacaccatgggctacggggaatccatgtattacaacgatgcatatggagcactcgactactataagcgataccgggtccgctcttatgaggcagtagcagcggcggcagcggcttctgcatacaactacgcag

SEQ ID NO: 177799 - DNA, 324 bp, Homo sapiens
  Payload ID: 14886
  Gene Symbol: RBM4B
  Gene Name: RNA binding motif protein 4B
  ENST ID: ENST00000528106
  CDS Start-End: 1-62
atgacatggcccggtatgaacgggagcagtatgtggaccgagcccggtactcagccttttaaaaactggaggtgtgaacctcaaatggactgaataaccctgagttggttgcagtcccaggagcctgatgttaatgaggctgccaggatgaaatactccagaactgttggggatccaaattcgggtctcaccctagcagaactgatccaagaacgtcacaacttttgaagtcgattggcacagatcaagaccaagatttggccctttgtctgtaataagtagaggaacttggtgtaggataattgcggactgaaccctcgggct

SEQ ID NO: 177800 - DNA, 769 bp, Homo sapiens
  Payload ID: 14886
  Gene Symbol: RBM4B
  Gene Name: RNA binding motif protein 4B
  ENST ID: ENST00000531969
  CDS Start-End: 74-505
cgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggtaggataattgcggactgaaccctcgggctgcggtcatatatgagaacttgctccgcgcggtcccctttgccgggatgtttccattgcttcatgtttcagtaaacaaaaggagtttgtgaccaactatgttttctttcttaattcttctaagttgacttttctttcctcctgaaactagtctctgtagcctttcactctgttccttatattctcagcctctgagcagccctaggtaaggattatgctggcatcccctttttcctgtgcagtggaacccctctt

SEQ ID NO: 177801 - DNA, 1646 bp, Homo sapiens
  Payload ID: 14886
  Gene Symbol: RBM4B
  Gene Name: RNA binding motif protein 4B
  ENST ID: ENST00000531036
  CDS Start-End: 127-582
gtgcgtgagctggcgcgcgagaaagggcccggtcgcgtccaggctcgagcggccgtcgccattttgtaaggttctctctgacgtgggagccgccgtcgctgccgccacccggaggctcttgtcaggatggtgaagctgttcatcggaaaccttccccgggaggctacagagcaggagattcgctcactcttcgagcagtatgggaaggtgctggaatgtgacatcattaagaattacggctttgtgcacatagaagacaagacggcagctgaggatgccatacgcaacctgcaccattacaagcttcatggggtgaacatcaacgtggaagccagcaagaataagagcaaagcttcaaccaagttacacgtgggtaacatcagccccacttgtaccaaccaagagcttcgagccaagtttgaggagtatggtccggtcatcgaatgtgacatcgtgaaagattatgccttcgtacacatggagcgggcagaggatgcagtggaggccatcaggggccttgacaacacagagtttcaaggtgaactgctctgggcctgggtagtagcgccgagtggggtctagctcaaaacaggcaagaacacaagactatagaacttgctgggtggtctcttccattctgttttagctggaaataatagattatgtttaccgctcttaagcataatttacccctggggaagcaaacacttccccttttcaggtttgctaagatgttgctcaccgactgcatagaatcacaaactgtgggttactttaccctgcgggattcttgcattgattcgagtgctgttggaagtgtaatctgcttggggaaacgagtacctcatgagagaagggaggataaaggtccgtggcttacctgcttctttggtgatgatcaggaagccttatatttgagggtttaagtgcttaagatttatattctttactgctttgggtggatactggtgggaaagaagaaaaaagacatctagaggaagccctatattataaatctgggtggcaagtctggatctgcgggagtatctttttgttgatcaaagttgtgcagtctcttcaagcagagtcaaaaaaacatgccatggagtgttctgctccacctgttcatttcaccctcagaaaaggaaatttctaaatatatcagactcaatgggaatgatggtcccgcttctgaagaaatttcagtacaagcatcgtagagcatatcatactatttataccgataataaaggtacatatgttgtcattaataccacaagaggttgtcagaagactctagaactgtgctaatatggtaaccacatgcggcttagtaaattgaaattaacagattagataaaatttaaaattcagtttttcaagtgtataccagacacgtttcaagcactcagtagtcatgaggcctgtggctaccgtattaatagagacacagaacatttccatcatcatagaacattcttttggatagcactgttctacaagtgttttgttaacagtatcgtcttggacctcatgttcatagccacttttgtggttcctaagtcaacaccttttttgccctgagtgtcattaaaggggttgttaagaagtacttttgggtcttctattaaaactaaaaaacaaaa

SEQ ID NO: 177802 - DNA, 3188 bp, Homo sapiens
  Payload ID: 14887
  Gene Symbol: RBM5
  Gene Name: RNA binding motif protein 5
  Uniprot ID: P52756
  ENST ID: ENST00000347869
  CDS Start-End: 176-2623
aagcgtgaggtactgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagagatgaaataccgagaccgagctgcagaaagacgggagaagtacggcattccagaacctccagagcccaagcgcaagaagcagtttgatgccggcactgtgaattacgagcaacccaccaaagatggcattgaccacagtaacattggcaacaagatgctgcaggccatgggctggcgggaaggctctggcttgggacgaaagtgtcaaggcattacggctcccattgaggctcaagttcggctaaagggagctggcctaggagccaaaggcagcgcatatggtttgtcgggcgccgattcctacaaagatgctgtccggaaagccatgtttgcccggttcactgagatggagtgagagagagagagagagagagatgacaaggagcacaagaagtggtccatctcccgaattcgctgttaccgcctgtctctttaagggcatgccttgtgctgttaatagatcttagggtgaaccacttcattctgcagggttctccctcccaccttaaagaagttccccttatgtgggttgcctggtgaatggccttccttcccgccagagggcttgtgaacagaccggagaggacagtggattgtttatactccagtgtacatagtgtaatgtagcgtgtttacatgtgtagcctatgttgtggtccatcagcccctcacattcctaggggtttgagatgctgtaggtggtatgtgacaccaaagccacctctgtcatttgttgtgatgtcttttcttggcaaaagccttgtgtatatttgtatattacacatttgtacagaattttggaagattttcagtctagttgccaaatctggctcctttacaaaagaaataccttgagaaatgggtgtcctgtgtctctttattcttgggtgggtaggtgggtcaagcatgtctgagccagt

SEQ ID NO: 177803 - DNA, 938 bp, Homo sapiens
  Payload ID: 14887
  Gene Symbol: RBM5
  Gene Name: RNA binding motif protein 5
  ENST ID: ENST00000395174
  CDS Start-End: 1-171
agagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcagg

SEQ ID NO: 177804 - DNA, 580 bp, Homo sapiens
  Payload ID: 14887
  Gene Symbol: RBM5
  Gene Name: RNA binding motif protein 5
  ENST ID: ENST00000404526
  CDS Start-End: 165-580
actgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatgattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagc

SEQ ID NO: 177805 - DNA, 569 bp, Homo sapiens
  Payload ID: 14887
  Gene Symbol: RBM5
  Gene Name: RNA binding motif protein 5
  ENST ID: ENST00000441305
  CDS Start-End: 158-569
attttgtgtagccgccgaaccttgttggaggttctggggcgcagaaccgctactgctgcttcggtctctccttggggtaagtgcggcggctgtctgtaacgacgaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtg

SEQ ID NO: 177806 - DNA, 582 bp, Homo sapiens
  Payload ID: 14887
  Gene Symbol: RBM5
  Gene Name: RNA binding motif protein 5
  ENST ID: ENST00000437500
  CDS Start-End: 268-582
acgttattaatgtagtagatttcagtcagctcagtatcccagcttctacgaggttttacatttttcatcagaagtgtttgaatttcatgttgctccttgtattaatgaagacacttggattaatgttttaacggtcaactatcccacggagttgctttgatacaaaaccaaggagctgattgtagctctgccctttttgctttgtaattctaagaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggcctt

SEQ ID NO: 177807 - DNA, 427 bp, Homo sapiens
  Payload ID: 14887
  Gene Symbol: RBM5
  Gene Name: RNA binding motif protein 5
  ENST ID: ENST00000417905
  CDS Start-End: 66-427
cttgtctcctagaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtcctt

SEQ ID NO: 177808 - DNA, 560 bp, Homo sapiens
  Payload ID: 14887
  Gene Symbol: RBM5
  Gene Name: RNA binding motif protein 5
  ENST ID: ENST00000438369
  CDS Start-End: 129-374
ttttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagctttttagtcttgtcacccaggctggagtgcagtggtgcgacctcagctactcaggaggctgagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaagg

SEQ ID NO: 177809 - DNA, 2716 bp, Homo sapiens
  Payload ID: 14887
  Gene Symbol: RBM5
  Gene Name: RNA binding motif protein 5
  Uniprot ID: P52756
  ENST ID: ENST00000469838
  CDS Start-End: 165-596
actgtgggtaggagacggccgtcggcggaggcgccattttgtgtagccgccgaaccttgttggaggttctggggcgcagaaccgctactgctgcttcggtctctccttgggaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgagagcttgcttagttcctgatattattgttctcttccccattcccacctcagtccctaaagaacatcctgattcccccagtcttcaagcacatgaattcagaatgaaaggtttgccatggctaaggaatgtgactctttgaaaaccatgttagcatctgaggaacttttttaaactttgttttagggacttttttttccttaggtaagtaatgatttataaactcctttttttttttgactatagtcggttgcatggttactttaagcgtggaatcaaatggagtggcatttagttcaggcggcttgttccttgccatggcaaagtatcaagaagatccccaagtcaagtcacatttgtaaagctgcttcccaattggctttgtcacgcagtgttgaagcagtgggagagagattcacctgttataaaggaactgactaacacaagtatcccgtctatatctgaatgctgtctctaggtgtaagccgtggtttcgccttcgtggagttttatcacttgcaagatgctaccagctggatggaagccaatcaggttgcttcactcaccaagtctagatattcatgaaaatggaacaagtctgtacaattttaaaaaaaggttgaaggagtggtttgttccaaaggagtgacttttttttaaaaaaaaagctttgtatatattaaaattgatgttactagaataagtacagtaccaaggacttcattatagaatttgttctgcctttaaacatggctacctacctggcagggctttgttaactactgaatacctgtctggtaatcactaaaacatcttaatgtttcccttttttctagtttgttatattcctattatgtccattgagagtaagcttagtatatcaaactctccatttgacagtgaagagaacatagtgaaagtctgtggcggcatttttataagtaattccttatttctgcctgaagaccacaaagcctcctggaggcgtaactgctcagaccggtcttcagggaatatttaaggacttagtggaatttatgaacaataagtctgatgagattagcctgggagtggtgtcctgcagctgtctaatctagttagagtggcattaacattctaatctccttgagaatgccttttatagtctgttcaaagcaagtcattgatggttcttcgaggtagtgttaactgaagtgttcttcagtttgtcaagataatgttcagtgcttggcacttaaataacattttttgcaagaactccaaggcacattattgaatgcctttaaccaagtgcattctgggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagtttttaagcctctcattttcctaacccagaaatcacagcctgattttattaaaagtagagcttcattcatttcataccatagataccatcctagtaaatccagaacatatacaaggttcatgtgagtctgctttcttgacatgatagcattgtttgatgcagtggatatgtcagaatgactaacctaggagtttaaaactcctaagaaactaaaacctgtaagacatttaaaagtctccacaattttaatgtatacaaagctatgttactgtgtaacacattacagttcaaattcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccacccccaagaaaaagaaaa

SEQ ID NO: 177810 - DNA, 3750 bp, Homo sapiens
  Payload ID: 14888
  Gene Symbol: RBM6
  Gene Name: RNA binding motif protein 6
  Uniprot ID: P78332
  ENST ID: ENST00000266022
  CDS Start-End: 260-3631
acggcgggagtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtgatta

SEQ ID NO: 177811 - DNA, 582 bp, Homo sapiens
  Payload ID: 14888
  Gene Symbol: RBM6
  Gene Name: RNA binding motif protein 6
  ENST ID: ENST00000433811
  CDS Start-End: 354-582
agtagattaccggtcccgccgcggagcggccagctgtgaggctggggccggcgcgtggttgcggctctgtgctcctactcttcggagctgtaagcgggctgttcttgcggttttcctgtttcagatccaattctgtggcatcactaggaagggagctcttgtgcttagcacgtagcctcgtcctcagacttggacagacacaagggaggctccgctggaccggagggcacaagagctccgagcccggtcgtcggggcggtagaacctggaagcgggagagtggtctggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggag

SEQ ID NO: 177812 - DNA, 684 bp, Homo sapiens
  Payload ID: 14888
  Gene Symbol: RBM6
  Gene Name: RNA binding motif protein 6
  ENST ID: ENST00000421682
  CDS Start-End: 209-568
gaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacaggaagtgatggtgtctgcttcttttgcagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 177813 - DNA, 2324 bp, Homo sapiens
  Payload ID: 14888
  Gene Symbol: RBM6
  Gene Name: RNA binding motif protein 6
  Uniprot ID: P78332
  ENST ID: ENST00000422955
  CDS Start-End: 404-2209
agcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtg

SEQ ID NO: 177814 - DNA, 2260 bp, Homo sapiens
  Payload ID: 14888
  Gene Symbol: RBM6
  Gene Name: RNA binding motif protein 6
  Uniprot ID: P78332
  ENST ID: ENST00000442092
  CDS Start-End: 339-2144
gaaggcaagtcccctgcgcgcggggcacggcgggagtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 177815 - DNA, 695 bp, Homo sapiens
  Payload ID: 14888
  Gene Symbol: RBM6
  Gene Name: RNA binding motif protein 6
  ENST ID: ENST00000446471
  CDS Start-End: 228-695
caataattttatcctgtgtatttctcttgacttttttgatgtgaaaagcagagaggtaaagcattatttgacagatgtatggattcaagcaagaaactgaggtccaattgcaaagaaatggcttgtataactcagagccctgtctgaggaaacacagaggaccctagagggcggagaatgaacacagcgcaggggctagttccagagtcgcattctcgggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccc

SEQ ID NO: 177816 - DNA, 2128 bp, Homo sapiens
  Payload ID: 14888
  Gene Symbol: RBM6
  Gene Name: RNA binding motif protein 6
  ENST ID: ENST00000419610
  CDS Start-End: 230-337
agctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtg

SEQ ID NO: 177817 - DNA, 4010 bp, Homo sapiens
  Payload ID: 14888
  Gene Symbol: RBM6
  Gene Name: RNA binding motif protein 6
  ENST ID: ENST00000443081
  CDS Start-End: 920-3895
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggactgggtgaaagctttttctgcagcagtcatgttgaaaaccttgtgttgactttcctcgtgttctgaaatgggagcataaaagtttactccgccacttcgtcttaaaatagcaaaactttgctgttttctgcagatctaggaccttgttacagaactctgccaaaaaaaaaatgtttacagaagaatgtgctgtgattagagaagaatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtg

SEQ ID NO: 177818 - DNA, 2342 bp, Homo sapiens
  Payload ID: 14888
  Gene Symbol: RBM6
  Gene Name: RNA binding motif protein 6
  ENST ID: ENST00000434592
  CDS Start-End: 320-919
aggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcgtgtgtctggttctataggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagaaaaaataaaatttgaaccttttggagctgtgtgctaaatcttcagtgggacaatgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagagga

SEQ ID NO: 177819 - DNA, 473 bp, Homo sapiens
  Payload ID: 14888
  Gene Symbol: RBM6
  Gene Name: RNA binding motif protein 6
  ENST ID: ENST00000438912
  CDS Start-End: 113-473
gcattgatgggaagatggtagctgtaaacctggccactggaaaacgaaggagtgtctggaccacccaacctgcttgctgtctagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggccc

SEQ ID NO: 177820 - DNA, 4324 bp, Homo sapiens
  Payload ID: 14888
  Gene Symbol: RBM6
  Gene Name: RNA binding motif protein 6
  ENST ID: ENST00000454079
  CDS Start-End: 821-2914
ggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggactgggtgaaagctttttctgcagcagtcatgttgaaaaccttgtgttgactttcctcgtgttctgaaatgggagcataaaagtttactccgccacttcgtcttaaaatagcaaaactttgctgttttctgcagatctaggaccttgttacagaactctgccaaaaaaaaaatgtttacagaagaatgtgctgtgattagagaagaatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccaggtgagtttggggcttttttttttttttttttttttttacctctgtcaatgattcttttgagaaaagcacccataatttgctacttgaggattttattccctggattctctggatgctcattgcatgaaaagtggaaaagtttagatctatggaaacagaactgttgcctatatggaaaatcagtgccttgtggcaatacaggtaagaacagtgttgctcttgaaaaagtggacagtgggtggtctgaatgtgtcctggtccctggagtgggtttttagattgatgtggactcttcttagacttgtaagtaaaaaagttgtttcttcccctaaaagggaactgtgcgccttagacctggaattgctgggaaactgaaacattctgtagacttacttgtttccaactgtatcgcagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttaccgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgt

SEQ ID NO: 177821 - DNA, 1886 bp, Homo sapiens
  Payload ID: 14888
  Gene Symbol: RBM6
  Gene Name: RNA binding motif protein 6
  Uniprot ID: P78332
  ENST ID: ENST00000425608
  CDS Start-End: 142-1704
cggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaaga

SEQ ID NO: 177822 - DNA, 2064 bp, Homo sapiens
  Payload ID: 14889
  Gene Symbol: RBM7
  Gene Name: RNA binding motif protein 7
  ENST ID: ENST00000375490
  CDS Start-End: 144-947
acgtcgtcgcccgctgagagcaagcgcaacgggcgttttcgtttgtgacgccagggagcgtgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgtt

SEQ ID NO: 177823 - DNA, 712 bp, Homo sapiens
  Payload ID: 14889
  Gene Symbol: RBM7
  Gene Name: RNA binding motif protein 7
  ENST ID: ENST00000544313
  CDS Start-End: 60-272
gcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaa

SEQ ID NO: 177824 - DNA, 1908 bp, Homo sapiens
  Payload ID: 14889
  Gene Symbol: RBM7
  Gene Name: RNA binding motif protein 7
  ENST ID: ENST00000542140
  CDS Start-End: 7-378
gctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaa

SEQ ID NO: 177825 - DNA, 4243 bp, Homo sapiens
  Payload ID: 14889
  Gene Symbol: RBM7
  Gene Name: RNA binding motif protein 7
  Uniprot ID: Q9Y580
  ENST ID: ENST00000540163
  CDS Start-End: 643-1443
agatcgggttcaacggcagggattgggtaaggtgagaatctggcttggcggctccggccccggccatctggttcccttgggctccggccgccaccatccactcgacggctctcggcccgaacgcttggtcgcaccgcctgccgaggtcctagatgaatcgcttcaggcctggaaacgaggaagccgtctccggagaccatcgccaacgctgacgcccgcggtctgaggtcgccatgggaagagcggtaggccaccctgctcctctgatcaccggaggacagggacacattgttcagggccatattcaaacactgcccgcagtacttgcgttacgtccctttgtgaaggcaggcccttcgcggctccccagatcagtccagcctgtgtcggacccgatgactaagcacacaggaacccataactgagcctgcggaagagccagaagccgccttgcctttaacgaggggtatcctggcgagcatgcgcagaccgtccgcgcacgtcgtcgcccgctgagagcaagcgcaacgggcgttttcgtttgtgacgccagggagcgtgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttatttttttttttttatgtcactgacttcagagacattgtacacaaagaattaacatacttttattcactgattgcctgctgtttagaatatcagttctttaattttgagcatcctgaaatacatcttttgtacatatagagcatgatgtttcacaatcagattttcagtgacccctcgattatagcttggagtactttagttaccctcagtggtctctaggagttaaagtacacttagatttcctgtttataaatgaattcagtttttctgtttctaagtaaatgtagctattcaactactcactatagaattaagataaacaatttgtttgcttaagcattttcacagaatttgtttccaatgagattattatttttgggtatcttatccatatgaaaacttagtaggtttgtagatgttaacgaagattaatactgcatgtttgtttttgttttttttttgagacagagtcttgctacgacacccaggctagagtgcaatggcgggatctcaggtcactgcaacctccatatcccgggttcaagtgattctcctgccttagcctcccgagtagctgggattacaggcacccaccaccacgcctggctagtttttgtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccacagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctga

SEQ ID NO: 177826 - DNA, 692 bp, Homo sapiens
  Payload ID: 14889
  Gene Symbol: RBM7
  Gene Name: RNA binding motif protein 7
  ENST ID: ENST00000544582
  CDS Start-End: 7-669
gctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcaggtacgaaaggactatggataacatgacttcatcagcacagataattcagagatctttctcttctccagaaaattttcagagacaagcagtggtagtttcttcaaacctgtatactgatcagctgtctcatgaatacgggagaaaacctgcaggtctccgagagttctctccctgtgcaacttatcgcttttcagtgctgtgtaccggccattccagctgcctttgtttcgctggactctcagctgtgtcttctgaactcagtgagtttgccaggctctgcctgccctgtcccccaaccccacacaatgcagcctaaacgttccctcaaggtagcacgca

SEQ ID NO: 177827 - DNA, 6725 bp, Homo sapiens
  Payload ID: 14889
  Gene Symbol: RBM7
  Gene Name: RNA binding motif protein 7
  ENST ID: ENST00000541475
  CDS Start-End: 66-515
gtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtgaatttcaaacatgaagtgtctgttccttatgcaatgaatctacttaatggaatcaaactttatggaaggcctatcaaaattcaatttagatcaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtggtaggttgactatttttcaacttgaattgccaaaaaaaaatcatccttagttaaaatgttcgcattgtatcaaataactggtttttaattaactttgttaagttggaggttttgttcctttagtcctcaaggcgtaagtgaactttttagataactttttctcaaatttttgttagactagcatgatttgtagattgagcactcattttagttttcactgggctgaaatatatacttaaaagactgaagataaatagaagtaaaactgcttttacatttgtttttcttttcaaccatcatttactcattgtctgatgctcctgtaccctatcctgagtgacttatcataaacttgggtcttctagaccagttccattttaaacttaaccttttctttttttggtggtggtaacatcatcatgagactaggcttaaaatcttagctatctttcactgtttcatctttgtcatcatttgttcaagtaggaagctgttggtaactatttggtgcctaaatcatgatcttgacttgtagtccccaggcttttgtatttcataggtctgcaaaatgaaatatagaagtcaaaataaatttgagagaccagtataaaggatgttaacttttatgtacatattgcctatttttctaattgtaccgtagactattaaaataaaaatgatcatatactaatatttatccacaggcagaatttgggaaccaccggtctagtcaattatgcccccattttcccctcactagttcatcttgcacaccatttcagaattaatattacaattctgttttgcttatcttccttgcacattgactttccattgtttgtaagatgaagtcagattcctctagcccaattattagggattcttattgtctgattccagtaaaccctgtagccttacctttaattgttcactgcttattaagatctgaaggccgggtgcggtggctaacgcctgtaaccccagcactttgggaggctgaggtgggtggatcacgaggtcaggagttcgagaccagcctggccaagatggtgaaaccccgtctctactaaaaatacaaaaattagccgggcgtggtggcacaggcctgtagtcccagctacttgggaggctgaggcaggagaatcgcttgaacccgggaggtggagcttgcagtgagccgagatctgtaacctgtctcaaagaattacttggtattctatgaacctgttctgtgtttccctgttatttttgtttgtgcaatttccttttcttggcatatctctcccttaaaatatgaaaatattccatccattgttttaatacccagatcatatgccaccttcatgaaacctttcctaatgatactgatctcctgattctttgttttttacacagtgattttgcattatagtcattttgtgtgacttattctgagttgcattcttgaggacaaagagtagtatttatgtatatatatgtatcttgtaggtatacattggaatgattgaagctattgtactgctttagttgtggatccatctaggcaagagtgactttattttctttcattttctgttaactgaccaaatacatattagctttgatatctagaagtattaacatttccacttttcctattcctcagatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttatttttttttttttatgtcactgacttcagagacattgtacacaaagaattaacatacttttattcactgattgcctgctgtttagaatatcagttctttaattttgagcatcctgaaatacatcttttgtacatatagagcatgatgtttcacaatcagattttcagtgacccctcgattatagcttggagtactttagttaccctcagtggtctctaggagttaaagtacacttagatttcctgtttataaatgaattcagtttttctgtttctaagtaaatgtagctattcaactactcactatagaattaagataaacaatttgtttgcttaagcattttcacagaatttgtttccaatgagattattatttttgggtatcttatccatatgaaaacttagtaggtttgtagatgttaacgaagattaatactgcatgtttgtttttgttttttttttgagacagagtcttgctacgacacccaggctagagtgcaatggcgggatctcaggtcactgcaacctccatatcccgggttcaagtgattctcctgccttagcctcccgagtagctgggattacaggcacccaccaccacgcctggctagtttttgtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccacagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctgacttaagtacaaaattctcaacttaatatgacccctatttggcatgtgctacttcagtctcctctgatgacttccccactttagttctcatagtaactgcccttcactgctcaatctatgcattacttcctctagaaagcctttccagagctctgaaatccagattcagtgccaagttatgtattccccaaatatctttttcttttatcatagcctttagactgtattataattttctttttacttgtctgtctctgtagacagctctatgaagacagaccttatcttattcatcactgcattcccaggatccagtgcctggcatatatttaacagtgaaactttttgatgaaaggaagaacgtctgttaattgaataaggaaaaggaggattcaacacataaaactttgaataggctctctaaacctaaaacattgcatcctgagaattacatgtcacagtacatgtattctagaattctatttgttcattttgtcaaacttcaaaaagttttggatctgtattcatgaataatgtgtgactttgtttttattttattttaatttatttatggcagagcctcactctgtcacccaggctggagtagagtggcacaatctcagctcactgctacctccgcctcctgggttccagtgattctctcacctcagcctcccgagtagctggaattacaggcacccaccaccacgcctggctaatttttgtatttgtaatagagacgggttttccccatgttggccatgctggtcttgaactcccaacctcaggtgatctgcctgactcggcctcccaaagtgctgggattacaggcatgagtcactgtaccagcctgattttgttttttaattgtattatcttagtttggtttaggagtatggttctgctagccttataaaataaattggcaagcttatcatcttctatgcccccccccaaatttgaataataaaggaattagccgtttctgcaagatgtgttgaactcatttatacaactatctgggtttgctttggaaatagctctttgattgctttatcaatttcctttagagttatcttttcaggtttgctactttctcaggaaacaatttggataatttatacttttcaagaaaatcaaccattccctttttctgaatatattgctatagagttgtacatagtatttcttataatttttgtaaaactcctaatattgtcaatagtgcagttttagtttctgacgatatattttaccttccctctcatcctcagatgagactggctgtgctgttttggcatacatcttacatttatatatgttataagccccacactaccttgtttttgttaggcagattcttaaataatagaaaattatatataatacttaagaaaaaataggaaaaaaaa

SEQ ID NO: 177828 - DNA, 867 bp, Homo sapiens
  Payload ID: 14889
  Gene Symbol: RBM7
  Gene Name: RNA binding motif protein 7
  ENST ID: ENST00000545678
  CDS Start-End: 111-551
gggggcggcggcggcggaagcggatcgcactctctttgtgggcaaccttgaaacgaaagtgaccgaggagctccttttcgagcttttccaccagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttt

SEQ ID NO: 177829 - DNA, 3587 bp, Homo sapiens
  Payload ID: 14889
  Gene Symbol: RBM7
  Gene Name: RNA binding motif protein 7
  ENST ID: ENST00000624815
  CDS Start-End: 344-784
acgtcgtcgcccgctgagagcaagcgcaacgggcgttttcgtttgtgacgccagggagcgtgaggacgtggggcttccgtgaatgcgcagtgggtgcgtcggccacgaccttttggccaggttagggagggggcgacgctgagatgggggcggcggcggcggaagcggatcgcactctctttgtgggcaaccttgaaacgaaagtgaccgaggagctccttttcgagcttttccaccaggaagtagtcatgccccacaagatgtcagtttgtcatatccccaacatcatgttggaaattcaagccctacctccacatctcctagcagcaggtacgaaaggactatggataacatgacttcatcagcacagataattcagagatctttctcttctccagaaaattttcagagacaagcagtgatgaacagtgctttgagacaaatgtcatatggtggaaaatttggttcttcacctctggatcaatcaggattttcaccatcagttcaatcacacagtcatagtttcaatcagtcttcaagctcccagtggcgccaaggtacaccatcatcacagcgtaaagtcagaatgaattcttatccctacctagcagatagacattatagccgggaacagcgttacactgatcatgggtctgaccatcattacagaggaaagagagatgatttcttctatgaagacaggaatcatgatgactggagccatgactatgataacagaagagacagtagtagagatggaaaatggcgctcatctcgacactaacacatgttaaaaggacattgtttttatagggtcattttaggccctttgactaagttgatatggaaatattttgttgaaaaactgtacagagcagctttacaagttgtcacatttctttataaatttttttaaagctacagtttaatacaaaatgaattgcggttttattacattaataacctttcacctcagggttttatgaagaggaaagggttttatgcaaaagaaagtgctacaattcctaatcattttagacactttaggagggggtgaagttgtatgataaagcagatattttaattatttgttatctttttgtattgcaagaaatttcttgctagtgaatcaagaaaacatccaggttgacagtctaaaatggctactggtattttagttaattcaaaaatgaaacttttcagtgattcactttactaacattctatttgagaaggcttattggtaaagtttggggataaaggcattgcttaacttcttatataatttaggtataaattctgtgacatgctcttgagctttaccctagttgaacatacatgtgtagatttacacatactgtttcattctaaaatttagaaattgttcattaaatcccatttgaggtataagtcactcaggaagttaaaatatctctacacgtatatttttacattaaaaatacagtgttagcataaatccccttttcaggaagaacaaaaatgtcagtgcatagttagataaaatggtaaaatgttttactgaaagcatacttttttggaaaatagattcatgaagcctttaagtgctgcttctgtcagtcaaacgttaaaaactttaacattttcaaagtgcccagactgtgtacaaagacacatgtaatggagattgtacaggttgtttttttgtttgaacctttgaaagagtttaatcttaacgttttctaattttaaaattttaaaatcttgtttaacaaaagcttgtattaagatactgttttcatttcattacagaattgtttataaaagttcatttgttgaaaaataaggatcctttttaataccacagcatttgtactgttcctttttaatatactgaaaatataaaaggaagggtgtgtgttatttttttttttttatgtcactgacttcagagacattgtacacaaagaattaacatacttttattcactgattgcctgctgtttagaatatcagttctttaattttgagcatcctgaaatacatcttttgtacatatagagcatgatgtttcacaatcagattttcagtgacccctcgattatagcttggagtactttagttaccctcagtggtctctaggagttaaagtacacttagatttcctgtttataaatgaattcagtttttctgtttctaagtaaatgtagctattcaactactcactatagaattaagataaacaatttgtttgcttaagcattttcacagaatttgtttccaatgagattattatttttgggtatcttatccatatgaaaacttagtaggtttgtagatgttaacgaagattaatactgcatgtttgtttttgttttttttttgagacagagtcttgctacgacacccaggctagagtgcaatggcgggatctcaggtcactgcaacctccatatcccgggttcaagtgattctcctgccttagcctcccgagtagctgggattacaggcacccaccaccacgcctggctagtttttgtatttttagtagagatggggtttcaccacattggccaggctggtctcaaactcctgacctcaagtgatccacctaccttggcctaccgaggtgctggaattacaggtgtgagccaccgcgcctggcctaatactgctttattacaacgttatctgtgggtcggatccttttatattggttaacagatgaccctgactcagaataatctttttcaatggctttttgagggaagcttgtgaagttctggtgaatcttctttttcacttcactttcagtgagctgaaagtaaccaaactaaatacatgtattgtgtaaagggacaggacaagacagccttaaaaaattgaatatagttggtgagacaactcagaagtacaggtttgagcatcccttattcaaaatgcttgagaagtgttttgggttctggaatatttgcattaatgcttgccagttgagcatcccaggtccggaaatccacagtgctccaatgagcctttcccctgagtgtcacatctgtattggcactcaaaaagtttcatattttggagcatttcagatttcagatttgggatgcttcatctatattgacagctgcaagaacagaaaggaagaagagattatttttgtgggagaacagtttctcccatagtgtttcctgtggaatgctagtgtctcataaagtcttctaaaaaaaagaaaaaaaaaatcaaatgtttggaagccattttgtgttactgtgtgactttcttttactcaaaaacagcaccataaaatttctgacaagtactataggtaaagaaatccctttatacttaacctagtattttctacctttccccatctaaaataaaatttttataccactttctaattatgttgtgtgtgcccactttccccatacctactgctaccatcttagagtaggcaattttctcaagaggattattccaagaacaccctaatgttttcctgcttccagtcttctttcctcaaatttattccacactcttaagaattgaagatgtaaatctgtcactcgcctgaataaagcttcagtggcctctgactt

SEQ ID NO: 177830 - DNA, 796 bp, Homo sapiens
  Payload ID: 14890
  Gene Symbol: RBM8A
  Gene Name: RNA binding motif protein 8A
  Uniprot ID: Q9Y5S9
  ENST ID: ENST00000369307
  CDS Start-End: 35-556
gagcggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttct

SEQ ID NO: 177831 - DNA, 4961 bp, Homo sapiens
  Payload ID: 14890
  Gene Symbol: RBM8A
  Gene Name: RNA binding motif protein 8A
  Uniprot ID: Q9Y5S9
  ENST ID: ENST00000583313
  CDS Start-End: 111-635
agagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagtttttttttttgtttttgtttttgtgctctgcctaagaagtgcttgagaattgtgaggagtataaaaatagtcaaagctggctgggcgcggtggctcacgcctgtaatcccagcactttgggaggctgaggcgggcggatcacgaggttaggagatggagaccatcctggctaacacagtgaaaccctgtctgtactaaagatacaaaaaactagccgggcgtggtggtaggtgcctgtagtcccagctacttgggaactcgggaggctgaggcaggagaatgacctgaacccaggaggcggagcttgcagtgagcagagattgcgccattgcactccagcctgggcgacagagtaagactgtctccaaaaaaaaaaaaaataataatcaaagctcttggatttatagtttggtccacagccttgttttgatctttcctttatcctgttttattgccatttaccacgtactgtagaaacatccctttcaactgctgataacttggaaacaagcctacaaaaataagtaatttctaactactcctaatactacctataactacccctaagcccttaccactctaacgtgacattattaaattttttattttattaacactaatattttaactacaattacagcatatgggcaatacagaatttacctaaaaggatactaatttggaacaaaaaaaatcacctttcgcacatgtatcatgtcacaaccagtttgccattgaaacaaatagaggttgcaaatattgtcagattgtcaggctgtaagaaaggatgaaattcatttcccattgcatcatcttgtggcccatggatttcaagtgccttagccaaaatcatatagctagttagcagtagagccgagactcagaaaaaaacaaagtaaaacaggcagactgaaacaaaaagtcttctaattcccagtccacatgtaaaatttgcttcatataaacaaacctaattgtaaatggcactgtagcaacaggcttctttttaacacttggattggtaaaggtcttgtttgcaacatattagaagtattatttttctctttcccccccaccccacccccaacagagtctggctctgccgcccacgccggagtgcagtggtgcagtcttggctcactgcagcctccacttcccaggttcaagcaattctcgtgcctcagcctcctgagtagttgggattacaggtgctcaccactatacccggctaatttttgtatttttagtagagatggggtttcgtcatgttggccaggttggtcttaaactcctgacctcaagtgatccacccaccttggccttccaaaatgctgggattacaggcttgagccaccaggcctttctttgttcttaggagtatagtcagactaacttctagtagttatatttctaataattgaggatgtaagtaaggatcaaatcttaaatcagtataatgcattgtcattccagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacctagtactcaggttcagatgctcgcctctttgcaattttaacactcattcgacaataaagtcagtaaaaaacacaaa

SEQ ID NO: 177832 - DNA, 440 bp, Homo sapiens
  Payload ID: 14890
  Gene Symbol: RBM8A
  Gene Name: RNA binding motif protein 8A
  ENST ID: ENST00000633781
  CDS Start-End: 1-320
ctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccagagctacaaggttaaagtgcctgctttccagtaatggagattgagtcactattaatttgataaaagggccgcccagtatgcttgctctcttcttggccatgc

SEQ ID NO: 177833 - DNA, 751 bp, Homo sapiens
  Payload ID: 14890
  Gene Symbol: RBM8A
  Gene Name: RNA binding motif protein 8A
  Uniprot ID: Q9Y5S9
  ENST ID: ENST00000632555
  CDS Start-End: 22-546
gagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacc

SEQ ID NO: 177834 - DNA, 495 bp, Homo sapiens
  Payload ID: 14890
  Gene Symbol: RBM8A
  Gene Name: RNA binding motif protein 8A
  ENST ID: ENST00000632040
  CDS Start-End: 1-320
ctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggatctggagctgattattgcgaatttcgttcactaaagcctctgcttctggagactctccatctgttctggaggaggtcacttgttcaactgtcaaggttctgcagggaacgaagatctgggccgcccagtatgcttgctctcttcttggccatgc

SEQ ID NO: 177835 - DNA, 2012 bp, Homo sapiens
  Payload ID: 14891
  Gene Symbol: RBMX
  Gene Name: RNA binding motif protein, X-linked
  Uniprot ID: P38159
  ENST ID: ENST00000320676
  CDS Start-End: 156-1331
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaa

SEQ ID NO: 177836 - DNA, 940 bp, Homo sapiens
  Payload ID: 14891
  Gene Symbol: RBMX
  Gene Name: RNA binding motif protein, X-linked
  ENST ID: ENST00000419968
  CDS Start-End: 1-877
aaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggttggtgattttgctcattatggtcgtggagtgctgattgattcacagtagataaagctggcagtaagaaa

SEQ ID NO: 177837 - DNA, 2004 bp, Homo sapiens
  Payload ID: 14891
  Gene Symbol: RBMX
  Gene Name: RNA binding motif protein, X-linked
  Uniprot ID: P38159
  ENST ID: ENST00000431446
  CDS Start-End: 156-746
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggcatcttt

SEQ ID NO: 177838 - DNA, 577 bp, Homo sapiens
  Payload ID: 14891
  Gene Symbol: RBMX
  Gene Name: RNA binding motif protein, X-linked
  ENST ID: ENST00000563370
  CDS Start-End: 156-269
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagggtaacactttatttttctgaaaactactttttagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatg

SEQ ID NO: 177839 - DNA, 1852 bp, Homo sapiens
  Payload ID: 14891
  Gene Symbol: RBMX
  Gene Name: RNA binding motif protein, X-linked
  ENST ID: ENST00000464781
  CDS Start-End: 156-392
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgc

SEQ ID NO: 177840 - DNA, 2148 bp, Homo sapiens
  Payload ID: 14891
  Gene Symbol: RBMX
  Gene Name: RNA binding motif protein, X-linked
  ENST ID: ENST00000562646
  CDS Start-End: 156-1046
ctcgttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaagatactggttaagggtctttagtatcaccagcttgagtttttaggttcgtgagccagtttattaggctgtgtggtgcttgcttttaaagggatgtttgcttgcttttaaaggggtaactttatcagctgggcttttcctagttttgtgaggggctttttttgtttttctaagtttcttttgaggctgtttgcttgctttggaggggattttgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaatttta

SEQ ID NO: 177841 - DNA, 4887 bp, Homo sapiens
  Payload ID: 14891
  Gene Symbol: RBMX
  Gene Name: RNA binding motif protein, X-linked
  ENST ID: ENST00000568578
  CDS Start-End: 153-389
gttgcgcagtagtgctagcggcttcgcggttcggtcctcgcacccggcagccgccactggtgctgagctgctaggaagcccctatcgccgagctcgttggagcttgaacccattgtcacccctccgactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaagtactcttgatgaaagaccgtgaaaccaacaaatcaagaggatttgcttttgtcacctttgaaagcccagcagacgctaaggatgcagccagagacatgaatggaaagatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaagatactggttaagggtctttagtatcaccagcttgagtttttaggttcgtgagccagtttattaggctgtgtggtgcttgcttttaaagggatgtttgcttgcttttaaaggggtaactttatcagctgggcttttcctagttttgtgaggggctttttttgtttttctaagtttcttttgaggctgtttgcttgctttggaggggattttgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatgg

SEQ ID NO: 177842 - DNA, 1292 bp, Homo sapiens
  Payload ID: 14891
  Gene Symbol: RBMX
  Gene Name: RNA binding motif protein, X-linked
  ENST ID: ENST00000565438
  CDS Start-End: 337-1128
tcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccgtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaaccgctgccctctcgtagagatgtttatttgtccccaagagatgatgggtattctactaaagacagctattcaagcagagattacccaagttctcgtgatactagagattatgcaccaccaccacgagattatacttaccgtgattatggtcattccagttcacgtgatgactatccatcaagaggatatagcgatagagatggatatggtcgtgatcgtgactattcagatcatccaagtggaggttcctacagagattcatatgagagttatggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaa

SEQ ID NO: 177843 - DNA, 1528 bp, Homo sapiens
  Payload ID: 14892
  Gene Symbol: RBMX2
  Gene Name: RNA binding motif protein, X-linked 2
  Uniprot ID: Q9Y388
  ENST ID: ENST00000305536
  CDS Start-End: 65-1033
gcgcatgcgctgcgctgcctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgata

SEQ ID NO: 177844 - DNA, 798 bp, Homo sapiens
  Payload ID: 14892
  Gene Symbol: RBMX2
  Gene Name: RNA binding motif protein, X-linked 2
  ENST ID: ENST00000370947
  CDS Start-End: 29-205
cctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacagtaagtgtcctttcatttcctgcctcctgagtcgacagagtactttgtttctgtaatacattttgtggcatcacaaaaaccacttattttcactctaggctgaatggcatccctgcatggggagggctggagcttctgttctagatcagtcccaggacatggttctagaatgttctgtgggagatccaagaggtttgttaatttgggagggcatcttggggatcctagtctatttctgttgtttttcactgaggcttgttcagcctgggcctagactggaacagactggactccttgggctcttgcaaactaggggtaacccatggtcacagggcccttctggcccttacctgtgtggcgtcatacgattggggcaaagcacagaggaaattggggtaaaaaacagaaggtcgtagtttgctttctttgtttctcgatgagtgtaaggttagtgagcaaaggcaatctctgcctggaggctgagaatcacagcccgaagggaacaagaatgaataggagacctgtatattcttcattctgctgaggtgttagcagcagcatttcatgggagagggtgttggcagctcatactggtag

SEQ ID NO: 177845 - DNA, 892 bp, Homo sapiens
  Payload ID: 14892
  Gene Symbol: RBMX2
  Gene Name: RNA binding motif protein, X-linked 2
  ENST ID: ENST00000619267
  CDS Start-End: 65-892
gcgcatgcgctgcgctgcctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggctcagatgcacattctag

SEQ ID NO: 177846 - DNA, 4799 bp, Homo sapiens
  Payload ID: 14893
  Gene Symbol: RBMXL1
  Gene Name: RNA binding motif protein, X-linked-like 1
  Uniprot ID: Q96E39
  ENST ID: ENST00000321792
  CDS Start-End: 429-1601
cacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggataggaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggcaaaaaaaaaaaaaatccaaaatctatgagataattttgttaaagttggcttgcttgggcgggtgcttggtccagagggagaaaagaaggcatgatttcagaatactctggcagctttttaaattcagctttatcaagttacagtaaactgtatctgtttagaattacaactcaatggttattttgacagatgtatatgccatgaagccactgtcaccatcaacatgcagaacacttccatcgcccccaaaagattcctcaagttcctttgcagtccatccctcacgctgctgatttgtctttgtcaccatatattagtttgctttgtggtggtgtttagtattttatataaatgggattgtgtagcatgtacttttttgtttatggtttctttcacacacaatgactttgaaattcaccaggttgcagtgtatcagtagcttattccttttattgctgagtagtgtcccattatgtgaatatgccattatttgtttttctactcacctgttgatggaccttgggattgtttccagtttggggctactgtgaataaaactgttaggaacatttgtgtacaagccactgtgtagacataggttttcctttctcttgggtaaatacctaccagtaaaatggttgggttgcatggcagatttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagaca

SEQ ID NO: 177847 - DNA, 5084 bp, Homo sapiens
  Payload ID: 14893
  Gene Symbol: RBMXL1
  Gene Name: RNA binding motif protein, X-linked-like 1
  Uniprot ID: Q96E39
  ENST ID: ENST00000399794
  CDS Start-End: 717-1889
gtggcccccaccccttccctcctccatttccatccattccgcgatcgcggcggaccccaccgtcatcgcgcgccgtgagtcacactccacagccaatccctggccacatccgggctcgcccccgccccgcccccttgttcccgcaagcccggaactgcccaaatcccgcccctcccctcccaaaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctgaacattctgttgttttcctctgccatctagtggcaaaagaaagtaattttcctggttttttgaatggatagccataccttaaaaagcatccagattgcgcagtagtgctagcggcttcgcggttcagtcctcctaactgacagccgccactggtgctgagctgctaggaagcccctgtcggcgagcttgttggagcttgaacccactgtcacccctccgactcaccggcaaaaaaaaaaatggttgaagcagatcgcccaggaaagctcttcattggtgggcttaatacggaaacaaatgagaaagctcttgaaacagtatttggcaaatatggacgaatagtggaagtactcttgataaaagaccgtgaaaccaacaaatcaagaggatttgcttttgtcacctttgaaagcccagcagacgctaaggatgcagccagagacatgaatggaaagtcattagatggaaaagccatcaaggtggaacaagccaccaaaccatcatttgaaagaggtagacatggaccgcccccacctccaagaagtagaggtcctccaagaggttttggagctggaagaggaggaagtggaggaaccaggggacctccttcacgaggaggacacatggatgatggtggatattccatgaattttaacatgagttcttccaggggaccactcccagtaaaaagaggaccaccaccaagaagtgggggtccttctcctaagagatctgcaccttcaggactagttcgcagcagcagtggaatgggaggaagagctcctctatcacgtggaagagatagttatggaggtccacctcgaagggaaccgctcccctctcgtagagatgtttatttgtccccaagagatgatgggtattctactaaagacagctattcaagcagagattacccaagttctcgtgatacaagagattatgcaccaccaccacgagattatacttaccgtgattatggtcattccagttcacgtgatgactatccatcaagaggctatggcgatagagatggatatggtcgtgatcgtgactattcagatcatccaagtggaggttcctacagagattcatatgagagttatggtaactcacgtagtgctccacttacacgagggcccccgccatcttatggtggaagcagtcgctatgatgattatagcagctcacgtgatggatatggtggaagtcgagacagttactcaagcagccgaagtgatctctactcaagttgtgacagggttggcagacaagaaagagggcttcccccttctgtagaaagggggtacccttcttcacgtgattcctacagcagttcaagccgcggagcaccaagaggtgctggccctggaggaagccgatctgatagagggggaggcagaagcagatactagaaacaaacaaaactttggaccaaaatcccagttcaaagaaacaaaaaaaagagtggaaactattctatcataactacccaaggactactaaaaggaaaaattgtgttaccttttttaaattccctgttaagtcccttccgtaatttttatgttcttgtgaggaaaaaagtaaaacatgtttaattttatttgactttatgacattgcttttcaacaagcaaatgttaaatgtgttaagccttgtagtactagtgttgtaactttccaagtaaaggtgtccctaaagaccacttcctatctggtttttcccagtaaatgaggcaagcaattctaagatcttccacaaaacatctagccaactaaaatggagagatgaatcattctgcctatacaaacaagctagctattagagggtggttggagtatgctactcataagatttcagggtgttttctaactgaaatctcactgttctcagtatgcaaaacctgaaatcagatgcctatgtaaggaaagtgctattcacccagtaaacccaaaaaaagcaaatggataatgctggccattttgcctttctgacatttccttgggaatctgcaagaacctcccctttcccctcccacaataagaccatttaagtgtgtgctaaacaactacggaatactaaataaaaagtttggccaaaaccaaccatgaagctgcaaaggtgcttgctcttactctttcaaatttttgcaactctaatgtctcacttttaaaggaacagcttgattgcaaaggagaaaatagataagcaatgaatttatctccaacttcctaaaggcttatgacttctaaaaagtgaatctatcagcattccacatcagatttaaagcatcaaatgcctgtgaaacagcaaagatggttgaagattgtgctcattatgtttgtggagtgctgattgattcacagtagataacgctggcagtaagagaaatcaaatgctaagagttgttgaagcagaaggcggctgattgttggtaagtcagtgcagttgcataagcagtgctgtcagaattggtttggtgcaggcaatagattttgccttcaagggttcctgtggatctcaggaaggcatcagtgttgattaacactcataactagggagtgagtggtagttacttaagtaattgaccaaatggaaaaggggaagtaattaaggaaattggtaagtggaggtagtcaggaggttctcgtggtcctttacacagattttacagctttgggtttcattttgtttagctaaagtcatggggacaactcttcaatttagaacttaagatgaattataaaaatgatggatataagtggtagctctatctggtgaagtgtcttgtcagtaagtgaaacatttttttgtggtggcttatccacaaacagtttagttgtagaataaaacttatgagtgacatctggaaagtaacaaccatgctaagatggcaaacacactggaaacaattgggccacttggctttcttttgctgtattgttttataagcctgctttacctccccgtcttggaaacaagttttagtttattgctttggagactagagccaatagtgtaatgttctcaaaggaaacagacttgagttgttggattagaggaactaactcaacttctaattttttttgttgtaattatggcactgtcatgttttaacatttgcaactagggatagtaagtacaacatttttaactctcatttggcagactactactaatcacagaccacaagggtaatgaccaaatttatgtggttgttacacttccatagttgtcttagccgaatccttccatattcttatgattacttgggttaaagcttctgtgaggaccttttggctcttaagatatcctaaatatttaaaatatttagatatcctaaatataggatatagagtttgtaccaaatatgaatgaatattgttcaaagcaaggagtatgttaaaatgaccagacacctgtttgataaatagtttactgaactagcagacgtgtggaaaaagaatcagatcttgattcttctgggtttatactggttgtaaaacagaatgatattagaaaatgttttccttgtttaagtggtagttgaacatagaacttgggtattatagatcacttttcactttttggaatgttttgtattgaaacttaatacaactttaacatggcaaaaaaaaaaaaaatccaaaatctatgagataattttgttaaagttggcttgcttgggcgggtgcttggtccagagggagaaaagaaggcatgatttcagaatactctggcagctttttaaattcagctttatcaagttacagtaaactgtatctgtttagaattacaactcaatggttattttgacagatgtatatgccatgaagccactgtcaccatcaacatgcagaacacttccatcgcccccaaaagattcctcaagttcctttgcagtccatccctcacgctgctgatttgtctttgtcaccatatattagtttgctttgtggtggtgtttagtattttatataaatgggattgtgtagcatgtacttttttgtttatggtttctttcacacacaatgactttgaaattcaccaggttgcagtgtatcagtagcttattccttttattgctgagtagtgtcccattatgtgaatatgccattatttgtttttctactcacctgttgatggaccttgggattgtttccagtttggggctactgtgaataaaactgttaggaacatttgtgtacaagccactgtgtagacataggttttcctttctcttgggtaaatacctaccagtaaaatggttgggttgcatggcagatttatgtttaataaagtaactgccaaactgtttgttttccaaaggggctatacccttttatattcccaccagggttgtatagagttccaactgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaag

SEQ ID NO: 177848 - DNA, 1874 bp, Homo sapiens
  Payload ID: 14894
  Gene Symbol: RBMXL2
  Gene Name: RNA binding motif protein, X-linked-like 2
  Uniprot ID: O75526
  ENST ID: ENST00000306904
  CDS Start-End: 95-1273
gtaggagccgccctcgacgagcgagctcgaaggctgcgactggcgccgcctcaccgcctcccaccgccactgaccgaccgttcgaccggcaaacatggttgaagcggatcgcccggggaagctgttcattgggggcctcaacctcgaaaccgacgagaaagccctcgaagccgagtttggcaagtatggccgcatcgtcgaggtgctcctgatgaaagaccgagaaaccaacaagtcgaggggcttcgcgttcgtcacctttgaaagccccgcagacgccaaggccgccgccagagacatgaacggcaagtccctggatggtaaggccatcaaggtggcccaggccaccaaaccggcgttcgagagcagccggcggggcccgccgcctccccgcagccgcggtcgcccgaggttcctgcgcggaacccgcgggggtggcggcggcccgcggcgttccccatcccggggcgggcccgatgatgacggcggctacacggcggatttcgacctgcggccctccagggccccgatgcccatgaagcgtgggccgccgccgcgcagggtcggcccaccccccaagagggccgcgccgtcgggcccggctcgcagcagcggcggtggaatgcgcgggagggccctggccgtgcgggggcgagacggctactcaggcccaccgcgccgggagccgctgcccccgcgccgcgacccctacctgggcccgcgggatgagggctactcgtccagagacggctactcgagccgagactaccgcgaaccccggggttttgccccctcgcccggagagtacacccaccgcgattacggccactccagtgtccgggacgactgtcccttgagaggctacagcgaccgagacggctacggaggtcgcgaccgtgactacggggatcatctgagcagaggctcccatcgagagccctttgagagctacggagagctgcgcggcgccgccccaggacgggggacaccgccatcttacggaggaggaggccgctacgaggagtaccggggctactcacccgatgcctacagcggcggccgcgacagttacagcagcagttatggccggagcgaccgctactcgaggggccgacaccgggtgggcagaccagatcgtgggctctctctgtccatggaaaggggctgccctccccagcgtgattcttacagccggtcaggctgcagggtgcccaggggcggaggccgtctaggaggccgcttggagagaggaggaggccggagcagatactaagcaggaacagacttgggaccaaaaatcccttttcaacgaaactaacaaaaagaagaacctgttgtatggtaactacccaaggactagtacaaggaagagttgtttttaccttttaagaatttcctgttaagatcgtctccatttttatgcttttgggagaaaaaacttaaaattcgtttagtttagttttggaattgttaacgtttctttcaacaagctcctgttaaaagtatatgaacctgagtactagtcttcttacatttacaagtagaaattcgattaatggcttcttcccttgtaaattttcttgataaatgaggcaaacagttctaagatctttgataaacatctgctcacctaaaatggaaaaacggatcattctgctcatttaaaccaactagattttgggtggagagtgggagggattggtgtatgctactcttaagatttcagggtatctttcaaactgaatctttgtttccagtattaaaaagcaaacaaccagcaacaacaacaacaaaagtgatttagatcaaatgtttatgtaaagaaaattattttcactcagtaaatctgaaaagtaaatggataatgttggcca

SEQ ID NO: 177849 - DNA, 3442 bp, Homo sapiens
  Payload ID: 14895
  Gene Symbol: RBMXL3
  Gene Name: RNA binding motif protein, X-linked-like 3
  Uniprot ID: Q8N7X1
  ENST ID: ENST00000424776
  CDS Start-End: 16-3219
attcggcagggagacatgatggaagcggatcgcccagagaagcttttcattgggggcctcaacctcaaaaccgacgagaaagccctcaaagccgagtttggcaagtatggccacatcatcaaggtgttcctgatgaaagaccgaaaaaccaacaagtcgaggggcttcgcgttcgtcaccttcgaaagccctgcagacgccaaggctgccgccagagatatgaacggcaagtacctggatggtaaggccatcatggtggcccagaccatcaaaccggcattcaagagcagccgatgggtcccgccaacccccggcagcggcagtcgctcaaggttctcacacagaacccgtgggggtggcagcagcccacagcgacccccctctcagggcaggcctgatgacggccgcggctacgcggggtatttcgacctgtggccctacagggccccgatgcccaggaagcgcgggccgccaccgcggcactgggccagcccaccccacaagagggccacgccgtcgagcctggctcacagcgttggctgtggaatgcgcgggaaggcaccgactgtgtcggggcaagatggctactcaggcttgcagccacggcgctgggccggcccaccccacaagagggctgtgccccggtcaagcctggctcgcattggcggcagtggaatgcctgggaaggccccggccgtgtgggggcaagatggctactcaggcccgcgggtccgggagccactgcccccgtgccgcgaccctggggattttgtccctgcgctcagagactacagccgccgctattatggccactccagtgtcccggactaccgtcccttgagaggcgacggcaaccaaaatggctacaggggtcgcgaccatgagtacacagatcatcccagcaaaggctcctaccgagagcccctcaagagctacggaggcccatgcggcgctgcccctgtgtgggggacaccgccatcttatggaggaggatgccgctacgaggagtaccagggcaactcgcccgatgcctgcagtgaaggccgctcgtccgaggccttgccagtcgtcttgccagacgcctacagcagggaccactcgcccaaagcctatagtgggggccgcagcagttccagtaacggttacagccggagtgaccgctacggagaagaaggctgctacgaggagtacagaggccgctcgcccgacgcccacagcgggggccgcaacagttccagcaacagttacggccagagccaccactatggaggagaaggccgctatgaggagtaccgaggccgctcacacgaggcccgcagcgggggccgctccactgatgcccacagcaggggccggtccgacgacgcctacagtgggggccatgacagttccagctggagcgactgctgcggaggaggaggccgttatgaggagtaccaaggccgctcgctggatgccaacagtggaggctgctcgcccgaggcctacagtgggggccacgacaattccagctggagcgaccgctacggagtaggaggccactatgaggagaaccgaggccactctctggatgccaacagcggaggccgttcacccgacacccacagtgggggccacagcagttccagcaacagttacggccagagccaccgctatggaggagaaggccgctatgagtaccgaggccgctcgcatgacgcccacagtgggggctgctctgccgacgcctacagtgggggccacgacagttccagccagagcaaccgctacggaggaggaggctgctacgaggagtaccgaggccgctccctcgatgccaacagtggaggccgctcgcccaatgcctacagcgggggccacgacagttccagctggagccaccgctacggaggaggaggccgctacgaggagtaccgaggccgctcccttgatgccaacagtggaggccgctcgcctgatgcctacagtgggggccacgacagttctggccagagcaactgctacggaggaggaggccgctacgaggagtaccgaggccgcttgctcgatgccaacagtggaggccgctcgcctgatgcctacagtgggggccacgacagttccagccagagcaaccgctatggaggaggcggccgctacgaggagtaccgaggccactcgcttgatgccaacagcggaggccgctcgcctgacacctacagccggggccacgacagttccagccagagcgaccactatggaggaggaggtcgctcactcgatgccaacagcagtggccgcttgcctgacgcctacagtgggggccatgacagttccagccggagccaccgctacggaggaggaggccgctacgaggagtaccgaggccgctcgctcgatgccaacagcggaggccgctcacccaatgcctacagcgggggccacaacagttccagccggaacgacccctgcagaggaggaggccgctacgaggagaaccgaggtcactctctcgatgccaacagcggaggccactcacccaacgcctacagtgggggccgtgacagttccagcaacagttacgaccggagccaccgctatggaggaggaggccactacgaagagtaccgaggccgctcgcacgacacccacagcaggggccgatcgcccgatgcccacagcggggaccactacaccgaagcctacagcaggggccgcgacagtttcagcaacagctatggccggagtgaccattacggaagaggaggctgctacgaggaataccaaggccgctcgcccaatgcctacggcgggggccgcggcctcaacagttccaacaacagtcatggccggagccaccgctacggaggaggaggccgctacgaggagtaccgaggcccctcgcctgacgcccacagtgggggccgcgacagttccatcaagagttacggcctgagcgaccgctacggaggaggaggccactacgaggagtaccagggcagcttgcctgacgcctacagcggcgaccacgacagatccagcaacagttacggccggagcgaccgctactcgaggggtcgagaccgggtaggcagaccggatcgtgggctccctctgcccatggaaacgggcagccctcccctgcatgattcttacagccggtcaggctgcagggtgcccaggggcggaggccgtcaaggaggccgcttcgagaggggggaaggccggagcagatactaagcaggaacagacttgggcccaaaaattccttttcaaagaaacaaaaagaagaacctgttctatgttaactacccaaggactagtataagtaggagttgtttttaccttttaagaatttcctgttaagatctccatttttatgcttttgtgaggaaaaacttaaaattagtttgaaattgttaatgtttctttcaacaagttcttgttaaaagtataagatatg

SEQ ID NO: 177850 - DNA, 1491 bp, Homo sapiens
  Payload ID: 14896
  Gene Symbol: RBMY1A1
  Gene Name: RNA binding motif protein, Y-linked, family 1, member A1
  Uniprot ID: P0DJD3
  ENST ID: ENST00000303902
  CDS Start-End: 66-1445
ggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgc

SEQ ID NO: 177851 - DNA, 1718 bp, Homo sapiens
  Payload ID: 14896
  Gene Symbol: RBMY1A1
  Gene Name: RNA binding motif protein, Y-linked, family 1, member A1
  ENST ID: ENST00000361046
  CDS Start-End: 128-373
cttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 177852 - DNA, 1921 bp, Homo sapiens
  Payload ID: 14896
  Gene Symbol: RBMY1A1
  Gene Name: RNA binding motif protein, Y-linked, family 1, member A1
  Uniprot ID: P0DJD3
  ENST ID: ENST00000382707
  CDS Start-End: 153-1643
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 177853 - DNA, 1879 bp, Homo sapiens
  Payload ID: 14896
  Gene Symbol: RBMY1A1
  Gene Name: RNA binding motif protein, Y-linked, family 1, member A1
  Uniprot ID: P0DJD3
  ENST ID: ENST00000439108
  CDS Start-End: 119-1609
cagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatg

SEQ ID NO: 177854 - DNA, 1718 bp, Homo sapiens
  Payload ID: 14897
  Gene Symbol: RBMY1B
  Gene Name: RNA binding motif protein, Y-linked, family 1, member B
  ENST ID: ENST00000382639
  CDS Start-End: 128-373
cttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaagtaatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 177855 - DNA, 1921 bp, Homo sapiens
  Payload ID: 14897
  Gene Symbol: RBMY1B
  Gene Name: RNA binding motif protein, Y-linked, family 1, member B
  Uniprot ID: A6NDE4
  ENST ID: ENST00000383020
  CDS Start-End: 153-1643
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaagtaatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 177856 - DNA, 1491 bp, Homo sapiens
  Payload ID: 14897
  Gene Symbol: RBMY1B
  Gene Name: RNA binding motif protein, Y-linked, family 1, member B
  ENST ID: ENST00000619219
  CDS Start-End: 66-1445
ggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgc

SEQ ID NO: 177857 - DNA, 1718 bp, Homo sapiens
  Payload ID: 14898
  Gene Symbol: RBMY1D
  Gene Name: RNA binding motif protein, Y-linked, family 1, member D
  ENST ID: ENST00000382653
  CDS Start-End: 128-373
cttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 177858 - DNA, 1921 bp, Homo sapiens
  Payload ID: 14898
  Gene Symbol: RBMY1D
  Gene Name: RNA binding motif protein, Y-linked, family 1, member D
  Uniprot ID: P0C7P1
  ENST ID: ENST00000382680
  CDS Start-End: 153-1643
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 177859 - DNA, 1491 bp, Homo sapiens
  Payload ID: 14898
  Gene Symbol: RBMY1D
  Gene Name: RNA binding motif protein, Y-linked, family 1, member D
  Uniprot ID: P0C7P1
  ENST ID: ENST00000418956
  CDS Start-End: 66-1445
ggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgc

SEQ ID NO: 177860 - DNA, 1718 bp, Homo sapiens
  Payload ID: 14899
  Gene Symbol: RBMY1E
  Gene Name: RNA binding motif protein, Y-linked, family 1, member E
  ENST ID: ENST00000358944
  CDS Start-End: 128-373
cttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggaccgctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaagtaatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 177861 - DNA, 1773 bp, Homo sapiens
  Payload ID: 14899
  Gene Symbol: RBMY1E
  Gene Name: RNA binding motif protein, Y-linked, family 1, member E
  ENST ID: ENST00000382658
  CDS Start-End: 118-1497
agggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggaccgctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaagtaatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgc

SEQ ID NO: 177862 - DNA, 1921 bp, Homo sapiens
  Payload ID: 14899
  Gene Symbol: RBMY1E
  Gene Name: RNA binding motif protein, Y-linked, family 1, member E
  Uniprot ID: A6NEQ0
  ENST ID: ENST00000382659
  CDS Start-End: 153-1643
atttccgggcacggcttccggcgtccttccctctcagggaagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggaccgctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaagtaatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 177863 - DNA, 1881 bp, Homo sapiens
  Payload ID: 14899
  Gene Symbol: RBMY1E
  Gene Name: RNA binding motif protein, Y-linked, family 1, member E
  ENST ID: ENST00000382673
  CDS Start-End: 113-1603
agctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgccaaagatatgaatggaaagtctttgcatggaaaagcaataaaagtagaacaagccaagaaaccatcttttcaaagtggtggtaggcggagaccaccagcttcttcgagaaacagaagcccttcaggaagtctgagatctgcaagaggaagccgtggaggaacaagagggtggcttccctcacaagaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcgtcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcctatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatgtggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaatttgacatgtactgcaa

SEQ ID NO: 177864 - DNA, 1887 bp, Homo sapiens
  Payload ID: 14900
  Gene Symbol: RBMY1F
  Gene Name: RNA binding motif protein, Y-linked, family 1, member F
  Uniprot ID: Q15415
  ENST ID: ENST00000303766
  CDS Start-End: 119-1609
cagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagaggtacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 177865 - DNA, 1810 bp, Homo sapiens
  Payload ID: 14900
  Gene Symbol: RBMY1F
  Gene Name: RNA binding motif protein, Y-linked, family 1, member F
  ENST ID: ENST00000454978
  CDS Start-End: 153-1532
atttccgggcacggcttccggcgtccttccctctcagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagaggtacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 177866 - DNA, 1886 bp, Homo sapiens
  Payload ID: 14901
  Gene Symbol: RBMY1J
  Gene Name: RNA binding motif protein, Y-linked, family 1, member J
  Uniprot ID: Q15415
  ENST ID: ENST00000250831
  CDS Start-End: 118-1608
cagggtagctccagctgtccctcccgcagttggccctgtggtgttccgaagccggttacgtacgcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 177867 - DNA, 1810 bp, Homo sapiens
  Payload ID: 14901
  Gene Symbol: RBMY1J
  Gene Name: RNA binding motif protein, Y-linked, family 1, member J
  ENST ID: ENST00000445779
  CDS Start-End: 153-1532
atttccgggcacggcttccggcgtccttccctctcagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 177868 - DNA, 1921 bp, Homo sapiens
  Payload ID: 14901
  Gene Symbol: RBMY1J
  Gene Name: RNA binding motif protein, Y-linked, family 1, member J
  Uniprot ID: Q15415
  ENST ID: ENST00000414629
  CDS Start-End: 153-1643
atttccgggcacggcttccggcgtccttccctctcagggtagctccagctgtccctcccgcagttggccctgtggtgttccgaagccggttacgtacggcctgagggccaggcgaacctcaggctctttgtcctactaaaaagcgcagcacaatggtagaagcagatcatcctggcaagcttttcattggtggcctcaatagagaaaccaatgagaagatgcttaaagcagtatttgggaaacatggtcccatatcagaagttcttttgataaaggatcgaaccagcaaatccagaggctttgcatttattacttttgagaaccctgcagatgctaagaatgctgcgaaagatatgaatggaacgtctttgcatggaaaagcaataaaagtagaacaagccaagaaaccatcttttcaaagtggtggtaggcggagaccaccagcttcttcgagaaacagaagcccttcaggaagtctgagatctgcaagaggaagcagtggaggaacaagagggtggcttccctcacatgaagggcacctggatgatggtggatacactcctgatctcaagatgagttattctaggggactcattccagttaaaagaggtccatcttcaagaagtggaggtcctcctccgaaaaaatctgctccttctgctgtggcaagaagcaatagttggatgggaagccaaggtcccatgtcacaaagaagagagaattatggagttcctccacgcagagcgacaatatcttcctggagaaatgatcgcatgtcaacaagacatgatggttatgcaactaacgatggaaatcatccaagttgccaagaaacgagggattatgctccaccatctagaggctatgcataccgtgataatggtcattctaatcgggatgaacattcctctagaggatatagaaatcatcgaagttcccgagaaactagggattatgctccaccatctagaggccatgcataccgtgattatggtcattctcgtcgggatgaaagttattctagaggatacagaaatcatcgaagttcccgagaaactagggagtatgctccaccatctagaggccatggataccgtgattatggtcattctcgtcgacatgaaagttattctagaggatatagaaatcatccaagttcccgagaaaccagggattatgctccaccacatagagactatgcataccgtgattatggtcattctagttgggatgaacattcctctagaggatatagttatcatgatggctacggtgaggcccttggtagagatcattctgaacatctaagtggaagttcttatagagatgcacttcagagatacgggacctctcatggtgcaccacctgcaagagggcctcggatgtcttatggtggaagcacctgccacgcatatagtaatacacgagatagatatggcagaagttgggagagttactcgagctgtggtgattttcattattgtgatcgtgagcatgtttgcagaaaagaccaaaggaatccgccttctctgggtagggtgctccctgatcctcgtgaagcatatggtagctcaagttatgtggcatctatagtagatggtggggagagtcgatctgaaaaaggagactcgagcagatattaaagcaagcattgaaaataatagttattgcataccaatccttgtttgcaaatcaaaaattgaaatgttatttctgcattgttacctgcatattactgaaagaaacatgttggttttgtggagagaggtagatactaacttcctccatgaattttttgaggtattcaaaggaaaaggaattgttttcaaagtaatttcatacttgttgatgctatttgaaaagtgtttagatgtaatatctaccttaaaattttcacaataaaattttacatgtactgcaa

SEQ ID NO: 177869 - DNA, 4273 bp, Homo sapiens
  Payload ID: 14902
  Gene Symbol: RBMS1
  Gene Name: RNA binding motif, single stranded interacting protein 1
  Uniprot ID: P29558
  ENST ID: ENST00000348849
  CDS Start-End: 432-1652
caccaagcgcagccgccgctgccgcactttccacttgtattgatcacctctcagccccgcgcagccggctcgcccgagcggaccgcggccagcgcgccagcccttggcagccccggagcagtcgggctccgggaggaaactccttgggagcgccctgtccggggtgccctctgcgctctgcagtgtctttctttctgcctgggaggaggaggaggaggaggaagaggaggaggaggaggaggaggaggaggaagaggaggaggaggaggaggacgtctggtcccggctgggaggtggagcagcggcagcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 177870 - DNA, 3781 bp, Homo sapiens
  Payload ID: 14902
  Gene Symbol: RBMS1
  Gene Name: RNA binding motif, single stranded interacting protein 1
  ENST ID: ENST00000392753
  CDS Start-End: 1-1161
tttttaaagtgtaaacagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttt

SEQ ID NO: 177871 - DNA, 1550 bp, Homo sapiens
  Payload ID: 14902
  Gene Symbol: RBMS1
  Gene Name: RNA binding motif, single stranded interacting protein 1
  ENST ID: ENST00000409075
  CDS Start-End: 126-1238
ggaaggattacactgttccaggttttagggagaaaggtttaccaaaccggtggccttaaatgattttcgctccttgatattatcatcttgaaggaaagctgcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaa

SEQ ID NO: 177872 - DNA, 1490 bp, Homo sapiens
  Payload ID: 14902
  Gene Symbol: RBMS1
  Gene Name: RNA binding motif, single stranded interacting protein 1
  ENST ID: ENST00000409289
  CDS Start-End: 66-1178
atttgccttctcttcacttggggagtatcaatttgccacagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaa

SEQ ID NO: 177873 - DNA, 1815 bp, Homo sapiens
  Payload ID: 14902
  Gene Symbol: RBMS1
  Gene Name: RNA binding motif, single stranded interacting protein 1
  ENST ID: ENST00000409972
  CDS Start-End: 451-1563
ggccgcggtaggtggggacgcggcggcgctgctcctccgctgccgccgggagagtcggcgacgccgccagctccgcgcgcgaactcccgtccatggcacgcagggcggcggctgcccgagctgctcgagtctcgcccgctgccgcgccgtacttttaggcgagtgcggaggtcgaaggcggaggggaagtcagcgcggagctgcagcccccgccggccgccgccgcgcggcgagagggagttcccagagctgccgcggccccgggcccggccggccacctccttgcgccctccccctcgcggcgaggctgccccgcgcccgcgcccgcgcccgcacccgccgccgccgcccgcagcgatgatcttccccagcagcagtggcaaccccgggggcagcagcaactgccggacgccctatcgcaagcagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaa

SEQ ID NO: 177874 - DNA, 583 bp, Homo sapiens
  Payload ID: 14902
  Gene Symbol: RBMS1
  Gene Name: RNA binding motif, single stranded interacting protein 1
  ENST ID: ENST00000428519
  CDS Start-End: 201-583
atttgccttctcttcacttggggagtatcaatttgccacagagcaagcaacagcgggtggtcctaggagacttctgtgtggtctagggagaccttgacacagtcgcctaagaatggaccgtgtttacagcctctaagaatggactgtgtttagaatgaggggcagcctgaaaaaggcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgct

SEQ ID NO: 177875 - DNA, 8382 bp, Homo sapiens
  Payload ID: 14903
  Gene Symbol: RBMS2
  Gene Name: RNA binding motif, single stranded interacting protein 2
  Uniprot ID: Q15434
  ENST ID: ENST00000262031
  CDS Start-End: 96-1319
ccctcgctcccctcctccctccctccccgtctttcttaccccctccctttctctctctctctctctctcgctcgttccctaacattaaagagaaaatgctgctatccgtgacttccaggcccgggatttcgacttttggctacaatagaaacaacaagaagccatatgtgtcattggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgcagcttctcatctatatgaaaaagttttcgatgtattggaattatttgggaatgcttttaaaacaatttgtaattatttctttacaaaccaaaacagaacagaaaggtgtggtgctggaacatcgatgaaggagccctacttactgagcttagttatggacttttttgatgcatgtgtgtatgtgttttaaaaagtatgcaggctctaaaaatgttattttgtaaagctctcagctcatgcaccccatctcctcttcacccatattatgccttctttctcttgtccagattcttctttttctcttttctaaacagctgagcctgcctactttgcccttttacagcttttaattttatggatttttaaaaatgaaatttcatgtggaatttggggttggggggcaggctgggcaaggaacaaggcagaacactaagtaggccatggaagtggctgttctttcccccaccctgccacaccctgggagaaaaaactagactttggcttcagaaagcacagatgtgacccaggcttactaaagagacaactccacagccctgggaacacacccttgagccaaacttggttgaagactaggtcttccctggcaagttccggaagaatggacttactgacttttatcaactcttctcactgccaaggccaacagcatctgaggtatagctttttgggagtacctgctttcttgcctcctggaggatattttctgtcctgggcttcatggcccctctcttccctgttacacattgctgtgctcagagcctttgcagctgcgacctagttgaatccacataggctccttccacacggtggaagatctgctgcttcactcacagaccaggagttctcaatcagaggtggttttgtccctcaggcctttggcaacatctagagacagttttgattgccacgcctggaggtgggatgtgtgtgctactggcatctagtggctgctaaacatcctacactgcataggatagtccccactacccccagccaagaattatctgactccaggggtcaatattgccaagactgggaaacactgatatagacagtgttgtccctgcctcctgggttagggtaaattttcaccccaaccctggacaaacagtgccttttgacactcatgcaactgttggggaaggactggactgggatccttgaattctccccagactttgacttttgataactctgcatatagcaagagtgattcttgaaagagctgtggctccatgctgaatgcacacatgtactcagagggattcaggtgggcattgttctggtgtgtgctgtgcaatggtgggaaaggacaaagctctctaaactgtccagagcaacctgccctgccccggtgtgcttggaccctttgcccagggaaccaggacatcagaaataatgttccttctgtggaaggacaacggggagctagggtagcaaagagcaataaattccaactctttatgaggtcaggagtcctttaaaaaagcctatgtcttggtctttaactgtccccttctgcaagatgtgactctatacacatggagacagattgaagaaagacttcacccatcttctaggaaataaaatcctgctcttgtcttctcccagtcactcccttatgcactgaaaggagaatttgactcccttgcacttcaaggccaggtgcctctccactagacagtcagacaaaggcaaataatggaggatagagagacaggtgttcattaggctggccatagggagaggaagggggtgacagcaggggaaaagaaactgtagtatcagttgtcacaagtagagctcggcccagctttccctcccttcccagccaccctagaattgagagtcccagtgcccctagtgtcgactttctatgtacatcctaggggtgagggagtgcggggcaatgggtaggatataaagcgtaaaggacaaattgccgcagtcttctaattgatgcttccaaactcaggaagggcttatccagtgtaaaatagccccaagcccagcaaccttctagagggctctggctgggcagatagcttttgtttttgagtctccagccctcagtcaaggaaaatataccatagctgctttcttgtcagtggcctttgagagaaagagaaaacaaatctagaattctgttcatctgatagaccgggggagctttgctatggtaggaggtttaggaagggcctttcacgcatagaaaccattgttgatattgccactcccctctcctctgcctcacagaactcctgattctgtcttctttctctctctatatatatattttaaaatgtttaaatggctctaattttttgttttgaattttgaatttaccttttggagttcttctcatgtgaatctacttgttagattgtattaatgagtgtttctggtttgggcatgggaagtgatgggggcctgaagttattttgcagtggctaatggcactgaggaatttcttttttggtgcatttggtttacactcatttcctctcctaattgttagttcatttgtaacagtgggtgagtgtttggaggaaaggagggagaagaaaggagggatactgtttctcccatgaaatagtctaattggttgggttgatggcagaaggaaacataggggagccttccagctcacagccaagggttgggctcttaaacactatgcctagtgttttctgaatgctgtcttcatggagcccagctcttactctctttgtactttacatctcacccccactcattacagatgctcataacattcttaaaatattttagtacttggcatttttctgttttcagtcagctagaacacactagagtcctttcctcagatggcataatcctttataggctctgagcctgcctagccatctcctatcggtgttattactcctcatctcaggctctgagatgatactcagaccctaaactgattggactttttggaggagggtgccagtagagaggtcaggaagatgtggagatgatgatggagagagatgtttttattttattttattttttcagacagagtcttgctctgtcgcccaggctggagtgcaatggcacgatctcggctcactgcaacctccgcctcccaggttcaagcaattctcctgcctcagcctcccatgtagctgggattacaggcacccaccaccatgcccggctaatttttttatttttagtagagatggggtttcaccatgttggccaggctggtctcgaactcctgacctcaggtgatctgcccgccttagcctcccaaagtgctgggattacaggcgtgagccaccgcgcccggcctttattttattttttagagatggtcttgctgtgtcacccaggctggagtgcagtgatgcagtcgtagtctactacagtcttgaattcctgggcccaagggttcttcccacctaagcctcccaagtagctggaagtacaggcacatactaccaagcccagttcgttattttaagtttttgtagagacaggggtcttactatgttgcccagactggtcttgaactcctgtcaagtgagcctcccacctcagcctcccaaagtgctatgattacaggtgtgagcctccatgcttggatgagatgttgtttttaatgtttttggttttttggttttgttgttttgtttttttgagacagggtctcactctgtggcccaggctggagtgcagtggcaccataatggctcactgcagcctcgacctcccaaggctcaggtgatcctcttgcctcagccaccccttccccggccaccaagtagctgggactatgggcttgtgccaccatgcctggctaatttttttatttttagtagagatggggttttaccacgttggccaggctagtgtccaactcctgacctccaaacagctaatttttgtatttttaatagagacaggttttcgccatgttgcccagcctcgtctcgaactcctgggctcaaatgatccacccacctcggcctcccaaagtgctgggattataggcatgagccaccacacctggccttttcagtttttttatttttattttttctttgagacggagtctcgctctgtcgcccaggctggagtgcagtggcgtgatcttggctcactgaaacctccatctcctgggttcaagcagttctcctgcctcagcctcctgagtagctgggattacaggtgcctgccaccatgcctggctaatttttgtatttttagtagagacagggttttgccacattgcccaggctggtgttgaactcctgggctcaaatgatccacctgccttggcctcccaaagtgctgggattacaggcgtgagccactgcacccggccctttgtagtgtttttaactaaagaatttgtagagttgcccaggccaggaagcctggtggctctaaagggtaatagaccttgtcagtaacagataaggagtggtaagaggacattactcatattgaagatgaagaccagactttgctgcttcacaggccatgcgctgggttgggccacttcagctccactccattcgttttcctttcctaacttgacaatcagctcactcaccctcccttagtgcctccagtgcctactcctgtcactccaatgtcaacccattgggagttgaggcctgtcactccaatgtcaacccgtgggctgttactttgcgtcatatgatgctgtgagaggccttgctggaatgtcctaggaatccctagtagcagtggctattagtcttctagaaaagaactattgctgctgccttgtgcacatgccccaccttctgggcaagtggcagcattgcgctcatgaggggctttgcattcttagccaagggcaataaactgggtgggtgatctggcccaaacttgcccctaggctctgctagccctgaatcagcaggcttcagagacgagggtgggtgttataaaagccagtctgtaaagggtaaattccaaatcttgtgccttgttataccaatccttcctgattcccgtttaaaccaactactctatttctgtgctgcctacattttcaatcctcccacgcattagcaaattcctgaaatttcctcatttggtaggccttccataggagtcagctatggacttccataggagttggcagctaaaaccagactgtgagcttctgtctccgttctgatttttgctgcacctcccaggggacagtccccacatgattacaaaagccaggtgccctcatcacccgttacccctgacctgtccacttgttttgaataaaccttcattctccaagcagatccccaaacttccttgtccttgttacacgtctacctcacaacctcacaattcaacaacaggtaaatacctggattcactgatttctttactgtccttctctgagggttgggaaggtgggggctagaaaaggctcataatttttaaactcttgggaattaaacttgggaatttctattcctacagtgttttctctgggatttttagctcactgatcgccctagaatagtgtgaactctccagataggtcctgctgtgataggccaggggagtaggctgtgcagtgacggcttagggtaataagtaatggttggaggacaccagcataggagcagagtttagaacttaagaggacaagaaagctgctcagtggctggcgtatagctgtgaaggtaaccaaacaccaaagagggagtctgtcatttttataaggctggaagcgaatgttccttttctaccttaacatacagtttagggggttgcaccaagacaaagtttccaggctggagggtaatacatatccagcgcgagtgaagtccccactccaacatataccctttttgggtgggtaaacacctctttgcatgtggacagaaaatgtttatacttaaacagacatattttgcatatttttatctggagacttcttctagttttatactcttcccacatctatgccaatgccaccattctaaaacttacactccttttctacccctggtcttttccttgtccttccctacaacttggtagaggtccattttgtcttacttcacacttttttttttttaaataaaacacaaaagtctacgtcttggtgtcttatccgtgagtgggaagtggtaagctggtgatggtcccatatttgctatgacaggaacacagaggtggcagcttaggaagctggggccacatctcacaaggcaggacctggatgcactgaatccccctttgctccagcaactcagccagacatttaggcaggagcactaatgaccctttccatccacacagagggtatggaacaggagcccctgttgttcccttgcctgtggtctcttaagccagtcatacctatcccaacgccgtctccccctcaggtgtgtagaagggaagatgaatacacagagtcttttgaatctctatcaaatgtggttttttttattcaacaactgacaagcacttttctacagctgcacttgtggaacatcacatggcaaaaacaggagttttttcgctagactttttttttctttttaaccttattaaaaatgagattggtcctaaaaatatagaaagaaataaatttaaattcacaaaaaactgtacattatcaaaaagtcactaaaacaccacatttggttatataaaaagtcccttttgctgtaaaaggaacacagaaactt

SEQ ID NO: 177876 - DNA, 1484 bp, Homo sapiens
  Payload ID: 14903
  Gene Symbol: RBMS2
  Gene Name: RNA binding motif, single stranded interacting protein 2
  ENST ID: ENST00000542360
  CDS Start-End: 234-1022
ctcgttccctaacattaaagagaaaatgctgctatccgtgacttccaggcccgggatttcgacttttggctacaatagaaacaacaagaagatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaaggctggagtgcaatggcgtgatctcgactcactacaacctctgcctcccaggttcaagcgattctctcacctctgcctcctgagtagctgggactacaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgcagcttctcatctatatgaaaaagttttcgatgtattggaattatttgggaatgcttttaaaacaatttgtaattatttctttacaaaccaaaacagaacagaaaggtgtggtgctggaacatcgatg

SEQ ID NO: 177877 - DNA, 1471 bp, Homo sapiens
  Payload ID: 14903
  Gene Symbol: RBMS2
  Gene Name: RNA binding motif, single stranded interacting protein 2
  ENST ID: ENST00000552247
  CDS Start-End: 67-1101
tctttcttaccccctccctttctctctctctctctctctcgctcgttccctaacattaaagagaaaatgctgctatccgtgacttccaggcccgggatttcgacttttggctacaatagaaacaacaagaagccatatgtgtcattggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgcagcttctcatctatatgaaaaagttttcgatgtat

SEQ ID NO: 177878 - DNA, 552 bp, Homo sapiens
  Payload ID: 14903
  Gene Symbol: RBMS2
  Gene Name: RNA binding motif, single stranded interacting protein 2
  ENST ID: ENST00000551369
  CDS Start-End: 36-218
ctctctctcgctcgttccctaacattaaagagaaaatgctgctatccgtgacttccaggcccgggatttcgacttttggctacaatagaaacaacaagaagatggagtttcgttcgctcttgttgcccagactggagtgcaatggcgtgatctcggctcactgcaacctctgcctcccagccatatgtgtcattggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatg

SEQ ID NO: 177879 - DNA, 1452 bp, Homo sapiens
  Payload ID: 14903
  Gene Symbol: RBMS2
  Gene Name: RNA binding motif, single stranded interacting protein 2
  ENST ID: ENST00000550726
  CDS Start-End: 234-1082
ctcgttccctaacattaaagagaaaatgctgctatccgtgacttccaggcccgggatttcgacttttggctacaatagaaacaacaagaagatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgcagcttctcatctatatgaaaaagttttcgatgtat

SEQ ID NO: 177880 - DNA, 1633 bp, Homo sapiens
  Payload ID: 14903
  Gene Symbol: RBMS2
  Gene Name: RNA binding motif, single stranded interacting protein 2
  ENST ID: ENST00000552916
  CDS Start-End: 35-289
tctctctcgctcgttccctaacattaaagagaaaatgctgctatccgtgacttccaggcccgggatttcgacttttggctacaatagaaacaacaagaagccatatgtgtcattggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccgctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacagtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgcagcttctcatctatatgaaaaagttttcgatgtattggaattatttgggaatgcttttaaaacaatttgtaattatttctttacaaaccaaaacagaacagaaaggtgtggtgctggaacatcgatgaaggagccctacttactgagcttagttatggacttttttgatgcatgtgtgtatgtg

SEQ ID NO: 177881 - DNA, 1598 bp, Homo sapiens
  Payload ID: 14904
  Gene Symbol: RBMS3
  Gene Name: RNA binding motif, single stranded interacting protein 3
  Uniprot ID: Q6XE24
  ENST ID: ENST00000273139
  CDS Start-End: 231-1493
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaactta

SEQ ID NO: 177882 - DNA, 2757 bp, Homo sapiens
  Payload ID: 14904
  Gene Symbol: RBMS3
  Gene Name: RNA binding motif, single stranded interacting protein 3
  Uniprot ID: Q6XE24
  ENST ID: ENST00000383766
  CDS Start-End: 231-1490
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccagggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccga

SEQ ID NO: 177883 - DNA, 1864 bp, Homo sapiens
  Payload ID: 14904
  Gene Symbol: RBMS3
  Gene Name: RNA binding motif, single stranded interacting protein 3
  Uniprot ID: Q6XE24
  ENST ID: ENST00000383767
  CDS Start-End: 337-1650
atcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgcca

SEQ ID NO: 177884 - DNA, 1120 bp, Homo sapiens
  Payload ID: 14904
  Gene Symbol: RBMS3
  Gene Name: RNA binding motif, single stranded interacting protein 3
  ENST ID: ENST00000445033
  CDS Start-End: 310-1104
caaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatgggtaagtagatcacattttct

SEQ ID NO: 177885 - DNA, 8540 bp, Homo sapiens
  Payload ID: 14904
  Gene Symbol: RBMS3
  Gene Name: RNA binding motif, single stranded interacting protein 3
  ENST ID: ENST00000434693
  CDS Start-End: 701-2011
acgctgctccctggagaggctctctcggttccacccaccggctggaaggaggggaagtgaatgaaaggacaggacaagccccgaacaccatgtcactctgggagggagacagcagcaactaagctgtacaaggttttttttttttttttttcttcctttttttctttttttttttctttttcccctttctttttctttctttctttctttttctttctttctttctctttctctctctcttttttctttttctttaaggtggggaaagagacaaccaagagacaggaagctgatctgcaaggattcggagttgtgctaaaaggactttgatttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccgacatggccggaccagttctttctttgttgtttgtttaaactaccttccactggtgttttacatagtgcaaaaaaaaaaagagggtggggggagttgtctctcttttctttaaatgtgtattcattgatagcagaagcttgtacctgctgtgtttagcagtttcagcatgaagagttctggatatgaactgattcatagagccaagtggctttaaattctgtgagcttttctggtttctcactagctgtcttgaatagtgaaacctgtattgatggccactagtaaaccaagatgcttatttaacaggtggaatattctttatatgaaatttcagctaaagacactttctggacctggtctgaaaggtcatttgtcaaaaaagcttagggatattctgtgaaatggtgagtggtctcctggaaaggtctcattgtatttgaacaatagtcttccctctaaattacaacacctctgggttttgtctttacacctctgtctttgtcatcacctaccatgaatagtcaccttggttttgcaaatggggagggggtatcatctttttgcctgttttcactgtatttttgtatattggtgttgccgaaagaactttttctttcagtttaattctttgaggcatgtaggaccaataagattgagaattctattggtggaatttagggaagtccttaaaatgctagttgacaatcaaggaacagtatgatttatatcaataagaaccaaaagaattaggtttgatcaatcatttaagccaaggaggaatacttgcatttagaacaatgcaaaactttgtctaaaatgaattaaattgacccacctgtaaaatatatctacatttttaattcatgagatgatatgtgttcaacctttacagttttacctgaaattaaggacaatggaatagaatttgttaagtgaaccattcactagattgctttctgaatgaatcctttgaatcaaataggtgaaactcttttcaaaaactaagtcagtcacaggagcctgtcttagtccaaaagaagcagggaaatgtatttaagtgtactataaaacagggtaggctttttaaaaactaaaaagttttaaaggtaaatcatattcccattaggtcaacatgagtaataaggttgactcatgtgaaattgtcaatattctactatttctgtaaactctggttctcttatttgcaaccccatgcactggaagcccaaatcagagaatgactccatatatttatggtcacattggagacaaaagtgtatccaagaaaatgtagtgtgcgttatagagaaattccaactggtcacactcaccattatggtttttcatgctttagagaaaatgctagatttatactgtcttttgttccatccttcagcttcccatgcattataaaggtggcacttaagtttttatctttgaaaagtgggccccaaagttttttggggtacaaaaagacatgtatgagaaccatattttctgtttctctttttcactctctaaactctttttgtataaataaggattatcctgggcataattcatttgaatatgaaaccaacatactttctttcatttttgtgaaaaaataaccaaaaacatgtattaatgtgatacaaagaaagtctcattcacacaatcaacaatgaggctaagaggtagctaccatgtggctaatgaatgtgcctaggtaacttcctgtttctattcaaaactgctgctttatttgtacattcagaaatatttttttcaactatgaaatttcaatatcaattttttaagccagtttctgcaaaaggaaatgacctgtcatttgatgtgttcatgtgtgttttgtgtttggatagtttatatcatgccattctataaaatgtatgttttcaaaccaaaaagaaaaaaaatagaaggaaaacaacggcacatactcaaatttgccctgctttgtctgttgtcttacctaagacttgttttgaagagccaagtctgggagagaaaaaaaagcatcaacaggtaagcagcattacattgtgtggtaataaaccaaaataagttttcaatatatacagacaacagaattcaaatttaatcaacaaaatatattgtagtgatttgtttgtttgtttgtttgagacggagtctcgctctgtcgcccatcctaactaggactataatctttttttttttctttaagttgaagttaattttctgtgcattctggtccaccagattttcaagcatttatttggatgtttccatttttccttttgactttaatagccaagacttagcttaaacatcaggaaacaaactaaagccacaatccaaatgagagaaacactgtctcgtctaaactctagtttcatggtcagtgcaacagtgagttttcttttaataatggtatggtattgtcaagggaggcaaagtgttcatggtaacttggagctccccaatacatggccatgtcttctaaagacaacgtaatgagcccaagtgaactgaaggtcatactggcaggtgctgatgacagtttgtccttgaatgctgacatgtcttgaatattgcaaatgtcataatactcttttaaaacagtcctctacctgactctagttttgcgaggattagtttgtttccttggtagatttcaacatttcagaatgttacctccaaatttcacttgaattacttcctcctgtgaccttagcagatctgtcacatttgaaagcatatgactcacttccacccccttctaatgaaaaactgcatggtgttaaaagcactctcattagaaatataaggctgagaactgaagaaggctgtttaaagcaggaatttcactttattttactatgcctaaaaatacatctttggaccccttgcaaagtgctttaaaagtactttcaatttatgcatgactccaaaaaagtaatttttttttcccaaaaaaacctctttatttaaataattgggatatttgctaaatacctatttttttttacagtggcctaaaacccctattaatgaaaagtgaaatttgatttaattaggactcttgcagtcatcttcacgactgaggagaagtttcaataggctgtctagacattatgatgttaataggagattaaaatacatttggcaattcattttcattcttaatttgagtgcatgaaccactgcagatgagctgataagcagaaattctcaagtgggtttcactaataaatgtttttttatatgatttgaaatcaagtaaagggacaatgtttatgtacgtgtataacaacattcagcacatttgaggaatcacacactataataaagcttaaacctgtcatagaaccttgatctatattactttgtcttcagtaaaaagtgaaggatgagattttgtctttcatgttattgtagctggcatgcttcaaaattttgagcttactgggactgacagcctctcacttcaatctgagggattgacagaatttaaacaggctcattgattctgtacactctacccttcctgtggcaagtgataatgggatttcattaatgaatcaatttgttttacaaatgacatccactgtggcattggaagacagttgggtctgactcaagtttaacatttcttaccaaacattcttaagtatgaaattggtcctttaatccaaatgctcttggtcatggctgtcctttgcggattacatagcattcaggaaagtacaaaaactaaacactaaatccccaactggccccaaagaccttttatgatgtgagagacaagagttcaccccagattaatttcttttatcattggctttatactctaacatatagatactctctatagcaaaaaagggatgaatggctttcaatattcatttctgtttatttttgtgagggaaaataatatatcaagaaaattttcttccacttagaaagctttaaagctgaagtagaggtgcagtcaagcttggatctgcaggaagaaccactaggccactgagtcatacttgagcttttcttactactgccccaatttctaaattgtgcataaatacaatcactctcaatttttgaagggctaattatctactttgtgggtgtgttttgttttttcttttcagcgtgtagggcttgggctctgtttccttttattagcatgtcacctgagggtggaacaaacaattggaaataaaatttgattattttatttcttataaagtattaatttcttaagggggtttgaaatcattggtaaaattaatatcagtacattatatgtcataaattttgattatctataatgtcttttcttatctaccacaaataattgagagttggctaaattcttgcagaatatatgggaaaaaaatcatagcaaagaattcagcttccctcaaaagaaagctatttttgtttccttcactccactaaatttgaaccagtagcacggatcaacacgacttctgcaatgagagtataacggtagctcttggtacagtcatattcatatttttaaatctttctttgaccaaaactattgcattgttttcattacattttgactgcgttacttattaaggccgaatgactttgacacccccgtggattatttttatgatcacatcaaatttaaacaatgtccaaagtgtaactttaatgttatattttgtttcaaaccctctggtctaagattattgagaaagatgttttttcctcctccctcaaatatgttatctcttcatatataaaaaaataagttattccatgcttttcaggaactgtaaaaattatttcaaaaagatatttgaaaaagttttctctattctggacacaaatgcttccatttatttcaaaagaagaagaagaaaaatggaatcttaatttaaaaaaatatatgtagtagtatctgctatgagatattcagtctctataaaaaaaaaaagggacacagcttcttttaaaacccttgtttcagtccatattcaacttcatggaacttctgaaacatcattcaattttgaactttatttaagagcatttttgtactgctgtctctgactgtcatggaaagttctgtaattctaaggtgtttctggttttatttttaatttcttcatctgtaccacagtcaaattagcaaccatctcccccatcccttgggctttctgtagatcagtggatgttaggtttaaacttctgttttctttgatgaagctttcaataaaaaatgaaaataaaatcaattgaa

SEQ ID NO: 177886 - DNA, 1547 bp, Homo sapiens
  Payload ID: 14904
  Gene Symbol: RBMS3
  Gene Name: RNA binding motif, single stranded interacting protein 3
  Uniprot ID: Q6XE24
  ENST ID: ENST00000452462
  CDS Start-End: 131-1396
gagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatg

SEQ ID NO: 177887 - DNA, 1394 bp, Homo sapiens
  Payload ID: 14904
  Gene Symbol: RBMS3
  Gene Name: RNA binding motif, single stranded interacting protein 3
  Uniprot ID: Q6XE24
  ENST ID: ENST00000456853
  CDS Start-End: 67-1368
agctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggtactcagaggcaggactgtccctaggcaaaatcgtgaagctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcc

SEQ ID NO: 177888 - DNA, 1276 bp, Homo sapiens
  Payload ID: 14905
  Gene Symbol: RNPS1
  Gene Name: RNA binding protein S1, serine-rich domain
  Uniprot ID: Q15287
  ENST ID: ENST00000301730
  CDS Start-End: 241-1158
agagcggcgccggcctcggcggctgaggaaagcaggaggaggtggcggcggcgggaagatgacgcgcacctttccggaggatgggggaggtaaccgaggtcctgagccggtacctgaacttgggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgca

SEQ ID NO: 177889 - DNA, 2241 bp, Homo sapiens
  Payload ID: 14905
  Gene Symbol: RNPS1
  Gene Name: RNA binding protein S1, serine-rich domain
  Uniprot ID: Q15287
  ENST ID: ENST00000320225
  CDS Start-End: 476-1393
ggaaaggggcggggcacgggcgcgttaacaccctccgcgccggaggacgagcctcggtcatcgcgctgccctcccaggttcaacaggctacccatgtgcccgctccagtaagcgtgcaaccagcccggtcagtcccagggactttaccggctaggagacaccttgaacgtccccagcgcgactcccacaaactgccttgactctttaacgcttcctcgctggcgcccattgggccaggcgtttacgtcatcgctgcgcgccgggcggcggcgacttcccgctccttgactctgacgtcagagcggcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaatcta

SEQ ID NO: 177890 - DNA, 2069 bp, Homo sapiens
  Payload ID: 14905
  Gene Symbol: RNPS1
  Gene Name: RNA binding protein S1, serine-rich domain
  Uniprot ID: Q15287
  ENST ID: ENST00000397086
  CDS Start-End: 304-1221
gctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaatcta

SEQ ID NO: 177891 - DNA, 1092 bp, Homo sapiens
  Payload ID: 14905
  Gene Symbol: RNPS1
  Gene Name: RNA binding protein S1, serine-rich domain
  ENST ID: ENST00000561518
  CDS Start-End: 240-1092
gtaagttggggcggaatccgactgcatccgtgtttcgggggctgcccggcaggcccggcaggacgcctcgtgaagccggtccactcctcagccccgcagtgcggcggtggcctggcagcgcggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgcc

SEQ ID NO: 177892 - DNA, 830 bp, Homo sapiens
  Payload ID: 14905
  Gene Symbol: RNPS1
  Gene Name: RNA binding protein S1, serine-rich domain
  ENST ID: ENST00000567147
  CDS Start-End: 16-789
ggcggcggcgggaagatggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggc

SEQ ID NO: 177893 - DNA, 479 bp, Homo sapiens
  Payload ID: 14905
  Gene Symbol: RNPS1
  Gene Name: RNA binding protein S1, serine-rich domain
  ENST ID: ENST00000565333
  CDS Start-End: 225-479
tgaagatttgtgccgaaacgccctctcctcgagatttaactaattgttctctcctctctctggctgttggacgcgcacctttccggaggatgggggaggtaaccgaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctca

SEQ ID NO: 177894 - DNA, 870 bp, Homo sapiens
  Payload ID: 14905
  Gene Symbol: RNPS1
  Gene Name: RNA binding protein S1, serine-rich domain
  ENST ID: ENST00000564311
  CDS Start-End: 155-625
tgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccagg

SEQ ID NO: 177895 - DNA, 574 bp, Homo sapiens
  Payload ID: 14905
  Gene Symbol: RNPS1
  Gene Name: RNA binding protein S1, serine-rich domain
  ENST ID: ENST00000569709
  CDS Start-End: 281-574
tgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtctcggtccagctcgacttccagctcaggctccagcaccagcactggctcaagcagtggctccagctcttcct

SEQ ID NO: 177896 - DNA, 1806 bp, Homo sapiens
  Payload ID: 14905
  Gene Symbol: RNPS1
  Gene Name: RNA binding protein S1, serine-rich domain
  ENST ID: ENST00000561718
  CDS Start-End: 595-981
cggcgggaagatgtaagttggggcggaatccgactgcatccgtgtttcgggggctgcccggcaggcccggcaggacgcctcgtgaagccggtccactcctcagccccgcagtgcggcggtggcctggcagcgcgggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaa

SEQ ID NO: 177897 - DNA, 1685 bp, Homo sapiens
  Payload ID: 14905
  Gene Symbol: RNPS1
  Gene Name: RNA binding protein S1, serine-rich domain
  ENST ID: ENST00000566397
  CDS Start-End: 461-847
ggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaa

SEQ ID NO: 177898 - DNA, 314 bp, Homo sapiens
  Payload ID: 14905
  Gene Symbol: RNPS1
  Gene Name: RNA binding protein S1, serine-rich domain
  ENST ID: ENST00000564822
  CDS Start-End: 227-314
agagcggcgccggcctcggcggctgaggaaagcaggaggaggtggcggcggcgggaagatgacgcgcacctttccggaggatgggggaggtaaccgaggtcctgagccggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctacca

SEQ ID NO: 177899 - DNA, 2037 bp, Homo sapiens
  Payload ID: 14905
  Gene Symbol: RNPS1
  Gene Name: RNA binding protein S1, serine-rich domain
  Uniprot ID: Q15287
  ENST ID: ENST00000566458
  CDS Start-End: 342-1190
acgggcgcgttaacaccctccgcgccggaggacgagcctcggtcatcgcgctgccctcccaggttcaacaggctacccatgtgcccgctccagtaagcgtgcaaccagcccggtcagtcccagggactttaccggctaggagacaccttgaacgtccccagcgcgactcccacaaactgccttgactctttaacgcttcctcgctggcgcccattgggccaggcgtttacgtcatcgctgcgcgccgggcggcggcgacttcccgctccttgactctgacgtcagagcggcgccggcctcggcggctgaggaaagcaggaggaggtggcggcggcgggaagatggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaatct

SEQ ID NO: 177900 - DNA, 1514 bp, Homo sapiens
  Payload ID: 14905
  Gene Symbol: RNPS1
  Gene Name: RNA binding protein S1, serine-rich domain
  ENST ID: ENST00000565870
  CDS Start-End: 608-1514
gtgttttgatgctggtaccagtcgcttttgaaatgatttttgcttccagtcacatccagtgtatcctaaggggaaattgcaataaaacaggagatctaatcctatctggagaccacccttgagttaggtttttctctgttctgcatgtgaatgtggtgctgtggcattttgaaaggactgcaggggctcatcaaacttgtgggtgaaaactgaattgttcagcctgtaaaataacagtgatggtctccaccatctccattttttaagaaaaagatacgctggggcgacagttgtacctgtgcctcctctgcggggtagagacgcctccaggagcacatggggactgtccctatgtgttcctgactgtgtggacacttattgcttaccgtgctcccttgctgcctttttgtgtgctcagcttttgactgcaaagtagacttgttgccttgccaattcgttcactctttaaacccttttatcttgttattaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaact

SEQ ID NO: 177901 - DNA, 582 bp, Homo sapiens
  Payload ID: 14905
  Gene Symbol: RNPS1
  Gene Name: RNA binding protein S1, serine-rich domain
  ENST ID: ENST00000562690
  CDS Start-End: 202-582
ggctgaggaaagcaggaggaggtggcggcggcgggaagatgatgggggaggtaaccgaggtcctgagccggtacctgaacttgggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttct

SEQ ID NO: 177902 - DNA, 666 bp, Homo sapiens
  Payload ID: 14905
  Gene Symbol: RNPS1
  Gene Name: RNA binding protein S1, serine-rich domain
  ENST ID: ENST00000565589
  CDS Start-End: 532-666
taattgtcaccatattgatgatgagaaacttgagaaaggataagtgacttgtctaaaatcacacagtaaaacctcaaatcaaacccaggccctctggctccagactctaaattatactctgaatgatactcactgattgtccgaggacacaaagagtgtcgaggcactatctgctgggtgtctgcagaaccttactgttctaaagcaaaacattttacccctggacaagagcagcaaaggtggcgttcggccctccttggctctcatttgactgttcaaagccaggtgcttttctttcttgggtcagaacgtattttcagcagcattttgaagcacccctggcgtgcactgcacagggaaaccaggaccacattggtgtgctgtgtcctccttaccaactggctcttggagaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagat

SEQ ID NO: 177903 - DNA, 639 bp, Homo sapiens
  Payload ID: 14905
  Gene Symbol: RNPS1
  Gene Name: RNA binding protein S1, serine-rich domain
  ENST ID: ENST00000564764
  CDS Start-End: 190-639
tggctgttggacgcgcacctttccggaggatgggggaggtaaccgaggtcctgagccggtacctgaacttgggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggag

SEQ ID NO: 177904 - DNA, 814 bp, Homo sapiens
  Payload ID: 14905
  Gene Symbol: RNPS1
  Gene Name: RNA binding protein S1, serine-rich domain
  ENST ID: ENST00000566180
  CDS Start-End: 396-814
gcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttaacgtattttcagcagcattttgaagcacccctggcgtgcactgcacagggaaaccaggaccacattggtgtgctgtgtcctccttaccaactggctcttggagaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaa

SEQ ID NO: 177905 - DNA, 903 bp, Homo sapiens
  Payload ID: 14905
  Gene Symbol: RNPS1
  Gene Name: RNA binding protein S1, serine-rich domain
  ENST ID: ENST00000564601
  CDS Start-End: 396-903
ggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcaccc

SEQ ID NO: 177906 - DNA, 2298 bp, Homo sapiens
  Payload ID: 14905
  Gene Symbol: RNPS1
  Gene Name: RNA binding protein S1, serine-rich domain
  Uniprot ID: Q15287
  ENST ID: ENST00000565678
  CDS Start-End: 547-1464
cggagtttctttgtgggatgcggtggaaggtcggccgatccccccttcggagtcattaattcaaacgtgtactccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatc

SEQ ID NO: 177907 - DNA, 1792 bp, Homo sapiens
  Payload ID: 14905
  Gene Symbol: RNPS1
  Gene Name: RNA binding protein S1, serine-rich domain
  Uniprot ID: Q15287
  ENST ID: ENST00000568631
  CDS Start-End: 739-1656
ctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtactccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccc

SEQ ID NO: 177908 - DNA, 918 bp, Homo sapiens
  Payload ID: 14905
  Gene Symbol: RNPS1
  Gene Name: RNA binding protein S1, serine-rich domain
  ENST ID: ENST00000569598
  CDS Start-End: 159-794
cggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagc

SEQ ID NO: 177909 - DNA, 2974 bp, Homo sapiens
  Payload ID: 14906
  Gene Symbol: RBPMS
  Gene Name: RNA binding protein with multiple splicing
  Uniprot ID: Q93062
  ENST ID: ENST00000287771
  CDS Start-End: 567-1181
atcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagctctgtgaaggtcagactgtgaggagaagccaccccttgagcgctccgtctcctgatagtgccagcctggcctggtttcctgtttgatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtca

SEQ ID NO: 177910 - DNA, 3110 bp, Homo sapiens
  Payload ID: 14906
  Gene Symbol: RBPMS
  Gene Name: RNA binding protein with multiple splicing
  Uniprot ID: Q93062
  ENST ID: ENST00000320203
  CDS Start-End: 583-1173
aaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatacccttcagcaatggctactagaaggacgaacaattgccctcctttggaagtacggctaatagaagccctagatccgaataagatccgaataagaatatgtaatggaccaggcgcagtgcctcacgcctgtcatcccagcactttgggaggctgaggcaggcggatcacttgatgccagaagtttgagaccagcccagccaacatggtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtca

SEQ ID NO: 177911 - DNA, 1341 bp, Homo sapiens
  Payload ID: 14906
  Gene Symbol: RBPMS
  Gene Name: RNA binding protein with multiple splicing
  Uniprot ID: Q93062
  ENST ID: ENST00000339877
  CDS Start-End: 583-1242
aaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaactc

SEQ ID NO: 177912 - DNA, 2941 bp, Homo sapiens
  Payload ID: 14906
  Gene Symbol: RBPMS
  Gene Name: RNA binding protein with multiple splicing
  Uniprot ID: Q93062
  ENST ID: ENST00000397323
  CDS Start-End: 615-1205
gggaggggagaggggagggaggaaggcgagagaaagggagctgcttccatcccggacttcccagagcctgcctggagcgcgtactcagcggctctcgggtcccagcgtcccagccgcggcccgcgctcctccgccccgctcctcctcctcctcttcctcctcctcctcctctctaggcacccccgtcccctccttccagcggctgcagcccccagccccaactctccgcgcttactcctgggacgcgcgtcctcgccccatcctttgcttccttccttccttccttcttccttcctcccctggctcccgccctccctctccaggtcgccctcccggggcccgattgtctcggtgccccgctcccggcccgcgccctgccccgtctctcccttgcacttcctgagtcgcccgccgccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgccaatcggctcttggtgagatgactgtactcctaaggaaaatagccacttctgcagtctattatgcttttataactgtttaaaggtacttttctattgtcatttttaaaaaataaagtgcttattccagctgtcacacca

SEQ ID NO: 177913 - DNA, 842 bp, Homo sapiens
  Payload ID: 14906
  Gene Symbol: RBPMS
  Gene Name: RNA binding protein with multiple splicing
  ENST ID: ENST00000520161
  CDS Start-End: 435-782
gtgcgggcggccggcggggcgcgggcccggggcgcggcggtggaagaaggttcaggcatggcccgtgccccggacgcagccccacagtgtggcccggggagggtggatctcgggagcgtgtgtttttgtgtccacgcgcgtctgcgggccccaaattgcgtaactccaaggacttttcggagacttttgtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgaga

SEQ ID NO: 177914 - DNA, 1076 bp, Homo sapiens
  Payload ID: 14906
  Gene Symbol: RBPMS
  Gene Name: RNA binding protein with multiple splicing
  ENST ID: ENST00000517860
  CDS Start-End: 9-683
ccgggaagatgaacaacggcggcaaagccgagaaggagaacaccccgagcgaggccaaccttcaggaggaggaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctgacactccttcaggactgacgaggatcgtctgacagcaatgatatcacccactgcctgatgtttgccccaaatgacacctctctcttccttaatgatctcacctcatatcgcacatgagagaccggggcaggtttatccacctggctcccagctagctagagggcatcaccagagtgtatacgtgtgtgccttgtgtggaagggctgcagaggaaggtgtgtgctaggagaaggggatatgtgcgtctgtgcgtgtttctgtgtgttgagagttttccactctcgtgtacggtgagaagaatctctgaccaaagggaaagcttccaggggggaaggctgtactttcttaaatatgttacaggaaagattaagggttccttctctccattttcagg

SEQ ID NO: 177915 - DNA, 449 bp, Homo sapiens
  Payload ID: 14906
  Gene Symbol: RBPMS
  Gene Name: RNA binding protein with multiple splicing
  ENST ID: ENST00000523115
  CDS Start-End: 302-449
gcagtacagttgctgcctcttacttgtcctgttatctgacagcgttccttttcaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgt

SEQ ID NO: 177916 - DNA, 780 bp, Homo sapiens
  Payload ID: 14906
  Gene Symbol: RBPMS
  Gene Name: RNA binding protein with multiple splicing
  ENST ID: ENST00000519647
  CDS Start-End: 364-711
agaacccaagttgtccaagagagatgtcgtgtacaaaacagttaagaccgtgaagagaggggggtttataatgtcagaaattgaggaaaagaaactaaggtggcctgaatgatccaggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaat

SEQ ID NO: 177917 - DNA, 839 bp, Homo sapiens
  Payload ID: 14906
  Gene Symbol: RBPMS
  Gene Name: RNA binding protein with multiple splicing
  ENST ID: ENST00000519359
  CDS Start-End: 1-359
ccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccattaggtggagctaatgaacatggagagaggcagtgaagtgcagaagtgaagggtctggactcatgatcttgattgattcacatcctggctctgtgagagtcgttgggctggatatttaacctcgctgtgtctcagctttctcataagatgagctcacagtgcctgcactttaccccagtagccctgaagtgtgggccccgtaccctctgtacccagcggagttagcgcctgctctacctcctcctgctttcacctatcccgcttcactgcatgcccagatgcgctggctccctccctccgaggctacttctcagggctggaagtcccgtcagttctgctgaatactatgtcccaggtgtgtgatggcggctgcaatctgtcttgtgggtattaatgcaatcttcagtggtggctactgttctctagctgttctacaaaactggagcatgctggcttgaaaaacccttgcccagttttgatcccttcaagactttgtcacagcctctatcacacatc

SEQ ID NO: 177918 - DNA, 1613 bp, Homo sapiens
  Payload ID: 14906
  Gene Symbol: RBPMS
  Gene Name: RNA binding protein with multiple splicing
  ENST ID: ENST00000520191
  CDS Start-End: 431-793
gtttgccttcgtctggctgagccgggctggtgcgctgagctctaggtgcaggcggaagctgggtcaggtgcgcggccgcacttctggttgcgcggcccacactggccgccattgtggtggaagtcggagcgagtctcctgggcccgaaccggctgttggaagtgcgagggcaccgagagccacggtccggaccctatttgtcagtggccttcctctggatatcaaacctcgggagctctatctgcttttcagaccatttaagggctatgagggttctcttataaagctcacatctaaacagcctgtaggttttgtcagttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctgacactccttcaggactgacgaggatcgtctgacagcaatgatatcacccactgcctgatgtttgccccaaatgacacctctctcttccttaatgatctcacctcatatcgcacatgagagaccggggcaggtttatccacctggctcccagctagctagagggcatcaccagagtgtatacgtgtgtgccttgtgtggaagggctgcagaggaaggtgtgtgctaggagaaggggatatgtgcgtctgtgcgtgtttctgtgtgttgagagttttccactctcgtgtacggtgagaagaatctctgaccaaagggaaagcttccaggggggaaggctgtactttcttaaatatgttacaggaaagattaagggttccttctctccattttcaggaaaccctgtagaaaaggagatacaagatagtgtctaagatggaattacaggtcaaggtagagatctctattctgaccagctttctttcttagttaaaaatagcctgatttttataaacaaacttcctgtttctccgcaaagattactgtctacatactaacacttcctctccccttggagaaaatatttctcttagcttcgcttttagtgcaagtggtagtaatcagtgtaaagattcacctctggagatcaccactcattctttggcctgcaaagattgatgaccagtaacaaatagaaagtacgtacgtaggtttcatttgtctttctgcatgtgtaattcagcctttaaattttaaatttttaaaaattattaggctggacaggcagagttttcgtttgcctgttttgctcagtgtttgtttac

SEQ ID NO: 177919 - DNA, 613 bp, Homo sapiens
  Payload ID: 14906
  Gene Symbol: RBPMS
  Gene Name: RNA binding protein with multiple splicing
  ENST ID: ENST00000522694
  CDS Start-End: 1-342
agttttgacagtcgctcagaagcagaggctgcaaagaatgctttgaatggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatatgagctcacagtgcctgcactttaccccagtagccctgaagtgtgggccccgtaccctctgtacccagcggagttagcgcctgctctacctcctcctgctttcacctatcccgcttcactgcatgcccaggaaaccctgtagaaaaggagatacaagatagtgtctaagatggaattacaggtcaagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatg

SEQ ID NO: 177920 - DNA, 2008 bp, Homo sapiens
  Payload ID: 14907
  Gene Symbol: RBPMS2
  Gene Name: RNA binding protein with multiple splicing 2
  Uniprot ID: Q6ZRY4
  ENST ID: ENST00000300069
  CDS Start-End: 269-898
actcgccggtcgcagtgaaaaggcggaggcggcggcccctccggctcccactgcctcccccgccgcaccccctccccaccttccgcacccgccaaacttgatgtgaccctggcccgacgcggaggctgcccctctcactgccccgtgggtcccccgccacccgctccgcacccgcgagcgcaccgctccccgcgccccttcccacttcccgcggggccggcgccgcgctcgccctcgcgttccttcccgccgccccctcccccgcaccatgagcaacctgaagccggacggcgagcacggcggcagcaccggcaccggctccggcgcgggctccggcggcgccctggaggaggaggtccggacactgtttgtcagcggcctccctgtggacattaaacccagagaactctacttgctcttccggccgttcaaggggtatgaagggtccctgatcaagctcactgcaagacagcctgttggttttgtgatctttgacagccgtgcaggagcagaagcggccaagaatgcgctgaacggtattcgctttgatcccgaaaatccacagactctgaggctagagtttgccaaagccaacaccaagatggccaagagcaagctaatggcaactccaaatcccagcaacgtgcaccccgccctaggagcacacttcatcgcacgggacccctatgacctgatgggggctgctctgatccctgcatccccagaggcctgggccccctaccctttgtacaccacagagctgaccccagccatctcccatgctgcgttcacctacccaactgccactgccgctgccgccgccctccacgctcaggtgcgctggtacccttcctctgacaccacccagcaaggatggaagtaccgtcagttctgttagtttttcagtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctcactgggacctggcaaggcctgacctcccgcccaaacttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttaagaaaatgaaatgaaggaaacactgtgcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaacc

SEQ ID NO: 177921 - DNA, 1746 bp, Homo sapiens
  Payload ID: 14907
  Gene Symbol: RBPMS2
  Gene Name: RNA binding protein with multiple splicing 2
  Uniprot ID: Q6ZRY4
  ENST ID: ENST00000560606
  CDS Start-End: 334-630
gttttccatcgggatgacaccgggagagctcgctcgaagcagtgggtaggggactgctgaagcacgtgcattcgttacttgaacattgtccggacactgtttgtcagcggcctccctgtggacattaaacccagagaactctacttgctcttccggccgttcaaggggtatgaagggtccctgatcaagctcactgcaagacagcctgttggttttgtgatctttgacagccgtgcaggagcagaagcggccaagaatgcgctgaacggtattcgctttgatcccgaaaatccacagactctgaggctagagtttgccaaagccaacaccaagatggccaagagcaagctaatggcaactccaaatcccagcaacgtgcaccccgccctaggagcacacttcatcgcacgggacccctatgacctgatgggggctgctctgatccctgcatccccagaggcctgggccccctaccctttgtacaccacagagctgaccccagccatctcccatgctgcgttcacctacccaactgccactgccgctgccgccgccctccacgctcaggtgcgctggtacccttcctctgacaccacccagcaaggatggaagtaccgtcagttctgttagtttttcagtctggtcaccggggaggtggttctggtaatctgtggtggtgccgggacaggcgccccgagttcccactgcccccgggcggcctgcacagagctgctgccctccagagactgtgaatcccaagcctgactcagtggactgcttcctgttcccctccctcctcttcctcaccttgttctgcaccctcaagcctttctccaatgcctcccaggaggatttggggactttctccctggggcgcccagatccagctcggaggcctcactgggacctggcaaggcctgacctcccgcccaaacttgcttctgtagctccccctcgaggaagtgaggtgtttaattttgcatgttttctggcatgaattaagacacttatacttgtatatatgagtgtacagtttgttctcacactgtcaccatagcgacaggtcctggctcccagtggttcatcctgcctgcccctctctcctcgccccgcccctgcacccaccccgcttcagggaggcccaagttccgtggccccacacgcttccaggctcagctcccacctccacccaacagatagatggggtttgctttttcatttcacatggggctcctccgctcctgccttctcggatgggccaacagtcgtaagaaagccctctctgcccgttctgttcacctctccacagcgcaccccgcccgccgctgctcctcattctttccaaacctcgaaaccaaccaaaacgtgagaagtatttttgtaccctgtgtaacaaaatatttatgcatcataaaggatttttcatgtgcgtaccattaattattaaagcgacctcgttcgccctgtcagataagtttaatgtttagtttgaggcatgaagaagaaaagggtttccattcttcagcagtacgcctttgtgtctggcatttgtttaagaaaatgaaatgaaggaaacactgtgcaatgttttttgttttgagcatatcagtgctttactgtcagccgcagctgtgaccgtctggccatttcagacttgggagatgaggcggctgttgtcattgctgatcctgtgagaatgtgaaactggataatatatgaaatgcaaaataaaacaaaaccaaaatg

SEQ ID NO: 177922 - DNA, 3268 bp, Homo sapiens
  Payload ID: 14908
  Gene Symbol: RBFOX1
  Gene Name: RNA binding protein, fox-1 homolog (C. elegans) 1
  Uniprot ID: Q9NWB1
  ENST ID: ENST00000311745
  CDS Start-End: 253-1509
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaa

SEQ ID NO: 177923 - DNA, 4099 bp, Homo sapiens
  Payload ID: 14908
  Gene Symbol: RBFOX1
  Gene Name: RNA binding protein, fox-1 homolog (C. elegans) 1
  ENST ID: ENST00000340209
  CDS Start-End: 298-1506
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 177924 - DNA, 3321 bp, Homo sapiens
  Payload ID: 14908
  Gene Symbol: RBFOX1
  Gene Name: RNA binding protein, fox-1 homolog (C. elegans) 1
  Uniprot ID: Q9NWB1
  ENST ID: ENST00000355637
  CDS Start-End: 253-1440
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaa

SEQ ID NO: 177925 - DNA, 1684 bp, Homo sapiens
  Payload ID: 14908
  Gene Symbol: RBFOX1
  Gene Name: RNA binding protein, fox-1 homolog (C. elegans) 1
  ENST ID: ENST00000422070
  CDS Start-End: 197-1474
agagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggt

SEQ ID NO: 177926 - DNA, 1530 bp, Homo sapiens
  Payload ID: 14908
  Gene Symbol: RBFOX1
  Gene Name: RNA binding protein, fox-1 homolog (C. elegans) 1
  Uniprot ID: Q9NWB1
  ENST ID: ENST00000436368
  CDS Start-End: 253-1431
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagttacggacgagtttatgctgccgacccctaccaccacgcacttgctccagcccccacctacggcgttggtgccatggctagtatataccgagggggatacaaccgttttgctccatactaaatgacaaaaccataaaaaccttccaatgtggggagaaaggaagctttccgaggcctgagtattgcaatacatgcagtagtacatcattttagcaactct

SEQ ID NO: 177927 - DNA, 1599 bp, Homo sapiens
  Payload ID: 14908
  Gene Symbol: RBFOX1
  Gene Name: RNA binding protein, fox-1 homolog (C. elegans) 1
  ENST ID: ENST00000535565
  CDS Start-End: 322-1464
gttttggcgcggacagaggccgaggccggccggggaagccggacccgggccctggcgccgccgtggcctccctttgtgcgcgcccgggtgttgattgcctccttgcacgggctgctcgctctcgcgcccgcgcgctcggggcgttctgcacctgctggcggtcgtgccaggcagcccgggcgagcgaaggcgcgcggcgcgcacgacagatgactggagtcatttacattgctagcacgtgggtgccgtttgctgttgcctcggacttctcccgtgctgtgttttcccggtgaggaaacaggaggcactttgcagccgacaatgaaatcttggcagctaattgcagtcgtgggagatgcccttcaggatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacaatttggtaaaatcttagatgttgaaattatttttaatgagcgaggctcaaaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgg

SEQ ID NO: 177928 - DNA, 3524 bp, Homo sapiens
  Payload ID: 14908
  Gene Symbol: RBFOX1
  Gene Name: RNA binding protein, fox-1 homolog (C. elegans) 1
  ENST ID: ENST00000547372
  CDS Start-End: 307-1707
aagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgccccaaggttccagccccagcacagacttcagaggagctaagctgcacacttccaggcctctgctgtcaggcagctgagaatctgactgcctctcctcccctattacaattcatgtttaaagtcatagtcgcccaggaaagaaaatagagaggggcacactttgtgtgtgtacctagtacataagaaagtagaaggaatcagctgggtttgggggttgccttttgttttggggcaggtctgggtttttgttttgggagggggtggggggagggtaaaaaatgggaggtaagggtggggtgaacttgcctgtacttgttcaaacttctatgcactgaaactcttgagtacagtaagacgtgcccatcacgtgagagcatatgcaatcattacaaagctttggcatgcagttttctgcttggatcaagaatatcagtccttaccctaaaaatgaatccccataggcattcatttgaattgccaatacttttagaaaaaggaaatcgttaagtgccaccttgtagccattaaaaccatggccggacagttcactgaagctcagtcatagaaattcagccatgatttggaagcattgttttgcacaagcttaattacatcaagcaattcatctgtacaactccacaactcccttctcaagatcagattccatacagcttacagagccaagttaagtaagaagtaggttgagattttcatcccaattctgcattcaacaactctgcttcaacacctagtccacatgaggaatgtgttggagagttgaattacattcaacaactggtccaaattcaacctcaagtgcagattattctgttataaaaaaatgagacagtgaaaatccttccattgtccagcttataatagagtccttttagctaagaggactggctgacagaatttggttttgcagggaatttctttaggaggagctattggggaaggtcaggaatggccctatctttagttctccaagaatgacctgggatgggtagggggtgcctccatttcggttggttttgagtgtctatttttcacattagtctttttgatgatccacatgttgcaaaaggaaaatgtaaaaaacacacccctcaaattgctttgtttcagaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaa

SEQ ID NO: 177929 - DNA, 974 bp, Homo sapiens
  Payload ID: 14908
  Gene Symbol: RBFOX1
  Gene Name: RNA binding protein, fox-1 homolog (C. elegans) 1
  ENST ID: ENST00000551752
  CDS Start-End: 186-974
gcggcgtgtgcgcctccggggctgctgattagaataggggacttggccgtggatggaatccgggaaacccaaaccggagatggaaggatgaggctgcgtttgcagcgcgtgaatgggacgcggatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgcc

SEQ ID NO: 177930 - DNA, 1513 bp, Homo sapiens
  Payload ID: 14908
  Gene Symbol: RBFOX1
  Gene Name: RNA binding protein, fox-1 homolog (C. elegans) 1
  Uniprot ID: Q9NWB1
  ENST ID: ENST00000547338
  CDS Start-End: 221-1414
gtgcatttgtgttgtgggggcatggggtgcatttgtgtgtatatatgtgtggatgtagggtgcgtttgtctgtgtgtatttgtgtgggcatggagtgcatttgcgttgcgggggtgtggagtgtgtttgtgtgtgtgcacacgcacatggttctcatggtcctcccgttttcaactgaacctgtaattagctcctcagagaccaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactct

SEQ ID NO: 177931 - DNA, 2196 bp, Homo sapiens
  Payload ID: 14908
  Gene Symbol: RBFOX1
  Gene Name: RNA binding protein, fox-1 homolog (C. elegans) 1
  Uniprot ID: Q9NWB1
  ENST ID: ENST00000553186
  CDS Start-End: 989-2101
tccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaa

SEQ ID NO: 177932 - DNA, 1430 bp, Homo sapiens
  Payload ID: 14908
  Gene Symbol: RBFOX1
  Gene Name: RNA binding protein, fox-1 homolog (C. elegans) 1
  ENST ID: ENST00000552089
  CDS Start-End: 115-1290
agatgactggagtcatttacattgctagcacgtgggtgccgtttgctgttgcctcggacttctcccgtgctgtgttttcccggtgaggaaacaggaggcactttgcagccgacaatgaaatcttggcagctaattgcagtcgtgggagatgcccttcaggatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacaacagatgacgcagcaccgacggatggccagccccagacacaaccttctgaaaacacggaaaacaagtctcagcccaagcggctgcatgtctccaatatccccttcaggttccgggatccggacctcagacaaatgtttggtggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaa

SEQ ID NO: 177933 - DNA, 4775 bp, Homo sapiens
  Payload ID: 14908
  Gene Symbol: RBFOX1
  Gene Name: RNA binding protein, fox-1 homolog (C. elegans) 1
  Uniprot ID: Q9NWB1
  ENST ID: ENST00000550418
  CDS Start-End: 989-2182
tccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 177934 - DNA, 1811 bp, Homo sapiens
  Payload ID: 14908
  Gene Symbol: RBFOX1
  Gene Name: RNA binding protein, fox-1 homolog (C. elegans) 1
  ENST ID: ENST00000547605
  CDS Start-End: 1026-1811
cgcacacacacacatgcacacattttctcgcgctctctccggctctcctttgtttattttctaatctatatttttactggaagatttcctctttattctctcccgccctcctacaagcgctcttgctggccgtctgggtgcacacaccgctccctcgatcaccccagcccccttcctggtctcccgagcgcggggtttgaaggtcacctcctttccagtccccgtgcgagccgcgctgccgccgcctcctccagccagagtcggtgggactggctgcgctgccctgaagtggttctccaagcagcgcggagggtggcggacggcggacggagcccaggggccgcgtcgggtggggaaacccgaactcgcggaggggaatccctccccctccgccccagccccccagcagcacccgcggtggggcgggggcgctctgccagccccgggaacagcagaggcggcggcactggctggacccacgcgcgcgcctccggggctgaagaaggaaggagtgagccgagccgagcaccccacatctggaggggacagccagccgtgggccccgccccggcgtccggagcaggagaactccgagcttcttgcccaggcagagagagcaggagcggaccgcgcgcccgggattgagagtccttgcgctccagacccccacccagtggccgccagggtccccgcctgtccggaccctcgccgcgcccaggcaggcgcgccagggcggggctgacctgcccgcgaagttgcggacagtgcgtgagaaaccagcacccccttccgccgcctccagcttatggtgagtgtggctgggggtgcagagagcgcacgggaattcgggggtctggggccgagaacgtgaccgcagccgggctcgccgggagttctaggaaactggtcaaagaactcatgcaagtggaacttacagcttccttgatcggactcagcattcagatatcaaagcagactgcaatacctgcgtggaaatagaagacagaaaggtttcaagacaacagatgaattgtgaaagagagcagctaaggggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacaacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgcc

SEQ ID NO: 177935 - DNA, 420 bp, Homo sapiens
  Payload ID: 14908
  Gene Symbol: RBFOX1
  Gene Name: RNA binding protein, fox-1 homolog (C. elegans) 1
  ENST ID: ENST00000567470
  CDS Start-End: 1-224
cgcacctgcgaggccgcggtcgcaccgtgtacaacaccttcagggccgcggcgcccccgcccccgatcccggcctacggcggggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgc

SEQ ID NO: 177936 - DNA, 725 bp, Homo sapiens
  Payload ID: 14908
  Gene Symbol: RBFOX1
  Gene Name: RNA binding protein, fox-1 homolog (C. elegans) 1
  ENST ID: ENST00000570626
  CDS Start-End: 159-725
agatgttgagggggaggtcagccaggcggcctcagccccccaccttcctcaacaccccgatcatccacacattgcacagcgcgcacaccctcgctcgtaattgaggcgtgcttggggcagatgctttgtggtgtgggacaagaacagctgctaagtttatggaggagaaaggaagcaggatggtgcagcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgag

SEQ ID NO: 177937 - DNA, 4018 bp, Homo sapiens
  Payload ID: 14908
  Gene Symbol: RBFOX1
  Gene Name: RNA binding protein, fox-1 homolog (C. elegans) 1
  ENST ID: ENST00000620507
  CDS Start-End: 298-1425
accttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcagtgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggtgttgtttaccaggatggattttatggtgcagacatttatggtggttatgctgcataccgctacgcccagcctacccctgccactgccgctgcctacagtgacagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaattacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctatttgggaagagtgtaagtgactacagtagtcatttttttctgcacctgcattattttattttgcgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttgaaaacaaagtttctgtagcttcgatacctaagacagacgatagtgatcttgaaaagagaaaagggggaggggggagctacttatcagccaaaagcatataaagtgttcttttcaccagacttctttgggtgggtgaggggaggggcaagagggtgttttatagcatcactaagacattctcattcccccacctggaaaacagtgttatggcaatgggtgcctggttgatgttcttaaaggaaacgaattattaaaacactatgacatcctccagagggaagaaagagtaggagcagggggctatggagaataaatttctcccaattgccgcctcagatttcaaaatccagaatttgtattgtgtttcgaatcacaaacatagaattcttactgtgttggttaaagtaaaattcatttgcagttttgattttcatcaatgagctgtactttcccccatgactgtatgtagttttaataaaatcatttagagtgagtgagtgccaaccgatgttgcagaatcttttgtctaggcactccaagatgccaataagtcattttaaaatgtatgtcagagatgtaaacaaacattttggattttttttaaacagtatttatttggaatgttttcatttatctaaataactattgctattatgaattatggaaaattaatattatgtgtggcatatagtgacttcttaacacacacatcacgcaatctgcaaacccagaaaatgtgtatatctgtctttagaaattagtgtttatatcacttacagtggtttgtgaataaagaaaactggtttgtaatatcaaaaaaataaaagcttagtctgaaaagg

SEQ ID NO: 177938 - DNA, 1538 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000262829
  CDS Start-End: 190-1266
ctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaa

SEQ ID NO: 177939 - DNA, 1409 bp, Homo sapiens
  Payload ID: 14909
  Gene Symbol: RBFOX2
  Gene Name: RNA binding protein, fox-1 homolog (C. elegans) 2
  ENST ID: ENST00000359369
  CDS Start-End: 85-1197
aacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatatagaatctgcaaactgcttcagatcaaacagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaa

SEQ ID NO: 177940 - DNA, 1354 bp, Homo sapiens
  Payload ID: 14909
  Gene Symbol: RBFOX2
  Gene Name: RNA binding protein, fox-1 homolog (C. elegans) 2
  ENST ID: ENST00000397303
  CDS Start-End: 34-1107
ggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttt

SEQ ID NO: 177941 - DNA, 759 bp, Homo sapiens
  Payload ID: 14909
  Gene Symbol: RBFOX2
  Gene Name: RNA binding protein, fox-1 homolog (C. elegans) 2
  ENST ID: ENST00000397305
  CDS Start-End: 376-759
gagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagctggaaggctgaagtctttcacctgagctgctgccagttcgctcttctgttcctgggtggttgggagaagagaagagggagggtattttatgctttaattaaagacagataagagagcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggtttggcaaaatcctagatgtagaaataatctttaatgaacgtggctct

SEQ ID NO: 177942 - DNA, 6932 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000405409
  CDS Start-End: 370-1473
attctccagcaggcctgcttctggagttgggagatgtcagcctgctgggagggggtggggggaggaggaagaggtggggctctactctgattaattaccttaggcattcaggggtggggcttccttcagccatctgcctgagatatgggagggagctggagaaagaaggagggggagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacacca

SEQ ID NO: 177943 - DNA, 663 bp, Homo sapiens
  Payload ID: 14909
  Gene Symbol: RBFOX2
  Gene Name: RNA binding protein, fox-1 homolog (C. elegans) 2
  ENST ID: ENST00000408983
  CDS Start-End: 63-663
atggtagctgtgtgcaaggggagagcagcagggtttagaattccaggaaggaagagagagtgatgtcatcagattccatggaccagcccaggaacccctgtgagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggcc

SEQ ID NO: 177944 - DNA, 1935 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000449924
  CDS Start-End: 190-1332
ctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctc

SEQ ID NO: 177945 - DNA, 1254 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000416721
  CDS Start-End: 67-1197
agaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctatt

SEQ ID NO: 177946 - DNA, 1706 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000414461
  CDS Start-End: 1-1113
atggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctc

SEQ ID NO: 177947 - DNA, 1356 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000438146
  CDS Start-End: 1-1356
atggcggagggcgcccagccgcatcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactga

SEQ ID NO: 177948 - DNA, 733 bp, Homo sapiens
  Payload ID: 14909
  Gene Symbol: RBFOX2
  Gene Name: RNA binding protein, fox-1 homolog (C. elegans) 2
  ENST ID: ENST00000495377
  CDS Start-End: 1-692
gctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggaatagtcttacaggaaccaatcattagcgctaaaatacctcagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttc

SEQ ID NO: 177949 - DNA, 789 bp, Homo sapiens
  Payload ID: 14909
  Gene Symbol: RBFOX2
  Gene Name: RNA binding protein, fox-1 homolog (C. elegans) 2
  ENST ID: ENST00000473487
  CDS Start-End: 88-789
ctactattgcattcatgaagaaggagggagatgaaaaattaggcattctaactgggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttc

SEQ ID NO: 177950 - DNA, 1935 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000619768
  CDS Start-End: 190-1332
ctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaataataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctc

SEQ ID NO: 177951 - DNA, 6932 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000618140
  CDS Start-End: 370-1473
attctccagcaggcctgcttctggagttgggagatgtcagcctgctgggagggggtggggggaggaggaagaggtggggctctactctgattaattaccttaggcattcaggggtggggcttccttcagccatctgcctgagatatgggagggagctggagaaagaaggagggggagagactgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaataataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcaagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctgaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacacca

SEQ ID NO: 177952 - DNA, 1537 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000631365
  CDS Start-End: 190-1266
ctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaa

SEQ ID NO: 177953 - DNA, 1354 bp, Homo sapiens; identical to SEQ ID NO: 177940
  Payload ID: 14909
  Gene Symbol: RBFOX2
  Gene Name: RNA binding protein, fox-1 homolog (C. elegans) 2
  ENST ID: ENST00000626598
  CDS Start-End: 34-1107

SEQ ID NO: 177954 - DNA, 1706 bp, Homo sapiens
  Payload ID: 14909
  Gene Symbol: RBFOX2
  Gene Name: RNA binding protein, fox-1 homolog (C. elegans) 2
  Uniprot ID: O43251
  ENST ID: ENST00000626107
  CDS Start-End: 1-1113
atggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaataataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctc

SEQ ID NO: 177955 - DNA, 789 bp, Homo sapiens; identical to SEQ ID NO: 177949
  Payload ID: 14909
  Gene Symbol: RBFOX2
  Gene Name: RNA binding protein, fox-1 homolog (C. elegans) 2
  ENST ID: ENST00000627612
  CDS Start-End: 88-789

SEQ ID NO: 177956 - DNA, 1170 bp, Homo sapiens
  Payload ID: 14909
  Gene Symbol: RBFOX2
  Gene Name: RNA binding protein, fox-1 homolog (C. elegans) 2
  ENST ID: ENST00000625456
  CDS Start-End: 1-1170
aacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcagtctccctttagttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactga

SEQ ID NO: 177957 - DNA, 811 bp, Homo sapiens
  Payload ID: 14909
  Gene Symbol: RBFOX2
  Gene Name: RNA binding protein, fox-1 homolog (C. elegans) 2
  ENST ID: ENST00000630250
  CDS Start-End: 1-684
ggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggaatagtcttacaggaaccaatcattagcgctaaaatacctcagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaa

SEQ ID NO: 177958 - DNA, 759 bp, Homo sapiens; identical to SEQ ID NO: 177941
  Payload ID: 14909
  Gene Symbol: RBFOX2
  Gene Name: RNA binding protein, fox-1 homolog (C. elegans) 2
  ENST ID: ENST00000629809
  CDS Start-End: 376-759

SEQ ID NO: 177959 - DNA, 1409 bp, Homo sapiens; identical to SEQ ID NO: 177939
  Payload ID: 14909
  Gene Symbol: RBFOX2
  Gene Name: RNA binding protein, fox-1 homolog (C. elegans) 2
  ENST ID: ENST00000627872
  CDS Start-End: 85-1197

SEQ ID NO: 177960 - DNA, 1254 bp, Homo sapiens; identical to SEQ ID NO: 177945
  Payload ID: 14909
  Gene Symbol: RBFOX2
  Gene Name: RNA binding protein, fox-1 homolog (C. elegans) 2
  Uniprot ID: O43251
  ENST ID: ENST00000627946
  CDS Start-End: 67-1197

SEQ ID NO: 177961 - DNA, 559 bp, Homo sapiens
  Payload ID: 14909
  Gene Symbol: RBFOX2
  Gene Name: RNA binding protein, fox-1 homolog (C. elegans) 2
  ENST ID: ENST00000626165
  CDS Start-End: 1-559
aacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgcagacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggcc

SEQ ID NO: 177962 - DNA, 1547 bp, Homo sapiens
  Payload ID: 14910
  Gene Symbol: RBFOX3
  Gene Name: RNA binding protein, fox-1 homolog (C. elegans) 3
  Uniprot ID: A6NFN3
  ENST ID: ENST00000584778
  CDS Start-End: 418-1395
agaagccgagggatgcagccaggggcacctcgcatggacgcctgccgcccgcctcagccctctgccctggggacacatggctgtgctggcagcagcaggttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatggtaaggagcccaggcccgcccagccctgggtgccagtcctaacagctgggcatgggtggtgaggcccttgggggagaggccgagccctctgaccaatgccttggtcccggagactttggaaggaccacggcctggatgtgagttagggtgaggggagggctggcccctcacgccctctcagttgcggggaagca

SEQ ID NO: 177963 - DNA, 1519 bp, Homo sapiens
  Payload ID: 14910
  Gene Symbol: RBFOX3
  Gene Name: RNA binding protein, fox-1 homolog (C. elegans) 3
  Uniprot ID: A6NFN3
  ENST ID: ENST00000580155
  CDS Start-End: 514-1452
gatacagcagcagctggtgctcctggccaggctgtgcgtgctctctctgcctctctctctcggactctctgctctctctctctgactctctcctctctctctgttggcctggtgaaatgttcttggctgtaggcacacagagccttggactcaaggctgttggagtcgaggacaccttgacttcggtcctggaggttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaac

SEQ ID NO: 177964 - DNA, 1143 bp, Homo sapiens
  Payload ID: 14910
  Gene Symbol: RBFOX3
  Gene Name: RNA binding protein, fox-1 homolog (C. elegans) 3
  ENST ID: ENST00000582043
  CDS Start-End: 74-1060
agagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggcactggagcaaacgcttgttaaaatgccagtcccatgggcggggctggcaccgtgccccctccctcctcagcagacaccggagccggcctaccccacctctccagcgttcccaccactttcttgtccgtttgcttccagggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaacaaaaaaaacaaaaaaa

SEQ ID NO: 177965 - DNA, 2934 bp, Homo sapiens
  Payload ID: 14910
  Gene Symbol: RBFOX3
  Gene Name: RNA binding protein, fox-1 homolog (C. elegans) 3
  ENST ID: ENST00000583458
  CDS Start-End: 320-1396
gttgaaattctgcctctgagaagctaacagtcttcctgtggtcgccactcctccccagcagccccctccttgccaaggacggtccagaaggagccccactggggcctccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggcactggagcaaacgcttgttaaaatgccagtcccatgggcggggctggcaccgtgccccctccctcctcagcagacaccggagccggcctaccccacctctccagcgttcccaccactttcttgtccgtttgcttccagggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaaacaaaaaaaacaaaaaaagatgttaagatccaagcaacaaaaaaaaaaccaaccaaaccaagaggcatccaaccaagtccaagtcccgcgtcctggccacacgcccgcaccgagggagcacgccggcaggggcgccgaggagcggccccaggacaggacggccccaccgcgtcctggctggcagcacagtgggaacacgcccctccgtctcaggcagtgggggagttggaggggaaggggcctcccttgtgggacccgtggggggctctgttttccatccagtcttcctttcccagcccccaactcccaagacagacagtgtggagcccagcggcggcggagcaggcccgggcctgagcaggcaggcgctgctagcaagacttgatctttgtggccagctgtgccagggggccggcggggctgaggggtgcgggcagctttcatcccaggggctccactgggccccgtcaccctcctgtcgcgtcccctgcgtcccacctccctcctgcccggcagtcccgcccgtgcccccagcctggcgaggaagccgtccaacagtagccccggggccagctcccaacagaaagggctgacgtggctccaggactcaggggcgctccatgggaggacgaaggaagcccagccagccaggagccactcctcacacctccaagtgtggccaagtgggccctgaggccaaggacttacttgctcttcctggccatctctccctttctggaggaggcccggggcctgtgtacaccaaggctgacctcgtgctgcctgctgggacccagccctccctgccgctcccctgtgagcccagtccaccgtgggcgcccagggccagggacgggccagcgcccggctgcatcgcgaggttgggagtcacagtggctgtgggcctggacgggcacagccagagcaggggcccatgggaagggcaagggatggggaagcctgggccggccccttccctgctcccaaggcaggtgtccaggtggcgggagcagcaccaaggacagccaggcttacccggtgggaggagcaggagcagagcaggtggcagggaggaacccctggcgaggcagggagcactgaagtagggaagcagcaaaaaatacaggctcccaacgtggctccactgtctcatgaagtgtcaaaaatttaaaaatacacctcactttctattcagcatcagctattgaaatggaattctccttttctattcccgttgtacatagccccacgccctgcctccggctttgtcctctgtacagagccccctgtcccctctgctgttccggacccttttcttgcagcagctcaaccccccgactcactcagatccccaggactgcagccgagccccgggcttcctttcttaccattctgtatgcttccaaggtgtgaccattcaaactaacagtattattaagattattaataaagatttctttcttcaaaccagga

SEQ ID NO: 177966 - DNA, 154 bp, Homo sapiens
  Payload ID: 14910
  Gene Symbol: RBFOX3
  Gene Name: RNA binding protein, fox-1 homolog (C. elegans) 3
  ENST ID: ENST00000582139
  CDS Start-End: 142-154
agatgaacagctgaccgtgttttcaaagataccacctggggaaacagccagaagctggaagtcatcccaagagagaagtcagccaggggttggagaccccagcagaagagcgatcaggacgccacggctccgcctgaagcgatggcccagccct

SEQ ID NO: 177967 - DNA, 877 bp, Homo sapiens
  Payload ID: 14910
  Gene Symbol: RBFOX3
  Gene Name: RNA binding protein, fox-1 homolog (C. elegans) 3
  ENST ID: ENST00000582880
  CDS Start-End: 1-227
gggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatggctagcctctgccgaggagggtacagccgcttcaccccctactagcaagagacccagcccctaacagcattcacactgactgcctattacacaccaaacccaacagcccaaaaccaggcacagccaccagaagacagtgcacccctcccggtcagcgacacgcacggctggccccctgcaactctaaaatctatagattatttctctccagccagttggtctccccaccccacctgtgctggtgtgtgtgtctttgaccctggtttttcctgtatgtctgcaaccgtgatttcctattttgactttgttgatgttgtactacccaagccattgcaggtacggtgtgcacaccgtggggtccaggctgggccaggagaccaggcagcccccaacctgggagtagcggtagcgccctatgagggcaagagccacatttcctggcctcccaggctgcacagaacaacagaaacgcctggcagggcctcccccaaagccacccgaccagccccgtgccatggccctagtgtccagcaccctgacgcagggagggaggggctccaggcacccagtgtgggtctccccggcctgagggtgctcccgcaggccttcacccagccaaccacaggagtagccactgcccctcctcgccccattcagctgaaactaatatttttcattaaattttattgacgata

SEQ ID NO: 177968 - DNA, 260 bp, Homo sapiens
  Payload ID: 14910
  Gene Symbol: RBFOX3
  Gene Name: RNA binding protein, fox-1 homolog (C. elegans) 3
  ENST ID: ENST00000580508
  CDS Start-End: 105-260
ggaggaggagagagaccgggagggcgcccgggaggcagggcgcgcgcacactccgagggacgcagcgagcgcagagccgccgccgggcgcccccctgccgccccatgctgtgctccatggcgaactcgggctgcctcctgctgtccaactccggcagcatgctcccgcactccgtgccctgcccgcccgccttcctctacctccaacagagcgatcaggacgccacggctccgcctgaagcgatggcccagccctacccc

SEQ ID NO: 177969 - DNA, 611 bp, Homo sapiens
  Payload ID: 14910
  Gene Symbol: RBFOX3
  Gene Name: RNA binding protein, fox-1 homolog (C. elegans) 3
  ENST ID: ENST00000582894
  CDS Start-End: 1-394
ggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatggctagcctctgccgaggagggtacagccgcttcaccccctactagcaagagacccagcccctaacagcattcacactgactgcctattacacaccaaacccaacagcccaaaaccaggcacagccaccagaagacagtgcacccctcccggtcagcgacacgcacggctggccccctgcaactctaaaatctatagattatttctctccagccagttggtctccccaccccacctgtgctggtgtgtgtgtctttgaccctg

SEQ ID NO: 177970 - DNA, 1161 bp, Homo sapiens
  Payload ID: 14911
  Gene Symbol: REXO2
  Gene Name: RNA exonuclease 2
  Uniprot ID: Q9Y3B8
  ENST ID: ENST00000265881
  CDS Start-End: 144-857
gttgagggcgagccggcgcaccgtacgctgggacgtgtggtttcagctcgtgcgcctccccgtgggtttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaa

SEQ ID NO: 177971 - DNA, 726 bp, Homo sapiens
  Payload ID: 14911
  Gene Symbol: REXO2
  Gene Name: RNA exonuclease 2
  ENST ID: ENST00000546316
  CDS Start-End: 1-204
attgagaaggaccagattattgagatggcctgtctgataactgactctgatctcaacattttggctgaaggtcctaacctgattataaaacaaccagatgagttgctggacagcatgtcagattggtgtaaggagcatcacgggaaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagcta

SEQ ID NO: 177972 - DNA, 452 bp, Homo sapiens
  Payload ID: 14911
  Gene Symbol: REXO2
  Gene Name: RNA exonuclease 2
  ENST ID: ENST00000544196
  CDS Start-End: 64-321
cgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaagtaaaagaggtgaggacgtatttctagattaatgactgcgtttgtggagtaccaggcttatcctccccacatatcaactgtaggagaatcatgagactttgtacttctcatcataacaacttttttaactttgtataaataaagccctgagttttaga

SEQ ID NO: 177973 - DNA, 791 bp, Homo sapiens
  Payload ID: 14911
  Gene Symbol: REXO2
  Gene Name: RNA exonuclease 2
  ENST ID: ENST00000539754
  CDS Start-End: 59-727
attgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctc

SEQ ID NO: 177974 - DNA, 449 bp, Homo sapiens
  Payload ID: 14911
  Gene Symbol: REXO2
  Gene Name: RNA exonuclease 2
  ENST ID: ENST00000538198
  CDS Start-End: 1-271
gggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaagaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaat

SEQ ID NO: 177975 - DNA, 880 bp, Homo sapiens
  Payload ID: 14911
  Gene Symbol: REXO2
  Gene Name: RNA exonuclease 2
  ENST ID: ENST00000544827
  CDS Start-End: 27-593
cacagaaaggattcaactcattcaagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctag

SEQ ID NO: 177976 - DNA, 539 bp, Homo sapiens
  Payload ID: 14911
  Gene Symbol: REXO2
  Gene Name: RNA exonuclease 2
  ENST ID: ENST00000543131
  CDS Start-End: 19-222
ggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggca

SEQ ID NO: 177977 - DNA, 475 bp, Homo sapiens
  Payload ID: 14911
  Gene Symbol: REXO2
  Gene Name: RNA exonuclease 2
  ENST ID: ENST00000541703
  CDS Start-End: 31-396
gactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaaggaaattcagttcatgaagataagaagtttcttgacaaatacatgccccagttcatgaaacatcttcattatagaataattgatgtgagcactgttaaagaactgtgcagacgctggtatccagaagaatatgaatt

SEQ ID NO: 177978 - DNA, 710 bp, Homo sapiens
  Payload ID: 14911
  Gene Symbol: REXO2
  Gene Name: RNA exonuclease 2
  ENST ID: ENST00000539275
  CDS Start-End: 46-285
cagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaa

SEQ ID NO: 177979 - DNA, 664 bp, Homo sapiens
  Payload ID: 14911
  Gene Symbol: REXO2
  Gene Name: RNA exonuclease 2
  ENST ID: ENST00000539119
  CDS Start-End: 1-577
cggacggttcggggcccgaggtgtccgcgaaggtggcgcagccatggcggcaggggagagcatggctcagcggatggtctgggtggacctggagggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcac

SEQ ID NO: 177980 - DNA, 1158 bp, Homo sapiens
  Payload ID: 14911
  Gene Symbol: REXO2
  Gene Name: RNA exonuclease 2
  Uniprot ID: Q9Y3B8
  ENST ID: ENST00000611665
  CDS Start-End: 144-857
gttgagggcgagccggcgcaccgtacgctgggacgtgtggtttcagctcgtgcgcctccccgtgggtttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgc

SEQ ID NO: 177981 - DNA, 1725 bp, Homo sapiens
  Payload ID: 14912
  Gene Symbol: RNGTT
  Gene Name: RNA guanylyltransferase and 5'-phosphatase
  Uniprot ID: O60942
  ENST ID: ENST00000369475
  CDS Start-End: 1-1725
atggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaa

SEQ ID NO: 177982 - DNA, 4553 bp, Homo sapiens
  Payload ID: 14912
  Gene Symbol: RNGTT
  Gene Name: RNA guanylyltransferase and 5'-phosphatase
  Uniprot ID: O60942
  ENST ID: ENST00000369485
  CDS Start-End: 313-2106
attcgtcgcgtccttaactctttgctatccttccgctgagcttcctcttctttccctctgacctcggaaagggggcggggctttcgggggcggaagttgcggtgcattgtgggttctcctggagctgtggagttgatcctgaatgaaagtggcgcgccgcccctgacgttacccggatcggagaggttggaattcagattacggctgcgattcgggtgtctcggaccccggtgtgcaccggaccacggggaggcggctccaaaggcgcggtgaacgttggtgagggagggcagctctgcgcagccccaagacatggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagctacttgaaggaaattttgccaaagaagtgagccatgaaatggatggacttatttttcagcctactggaaaatacaaacctggtcgatgtgatgatattttgaaatggaagcctcccagtctgaattctgtggattttcgtctaaaaataacaagaatgggaggagaagggttacttcctcagaatgttggcctcctgtatgttggaggttatgaaagaccctttgcacaaatcaaggtgacaaaagagctgaaacagtatgacaacaaaattatagaatgcaaatttgagaacaacagctgggtcttcatgagacagagaacagacaaaagttttcctaatgcctacaacactgccatggctgtgtgtaacagcatctcaaaccctgtcaccaaggagatgctgtttgagttcatcgacagatgtactgcagcttctcaaggacagaagcgaaaacatcatctggaccctgacacggagctcatgccaccaccacctcccaaaagaccacgccctttaacctaagacctgcctgtgacttgagggttaagaagaaagaggaatgaggaaaaaacgctgttgcccatttttgtagccagagaaattgaaaaacgactgtggcttgatgttgatacacatttgaattttttttaaaaaaagaaagttatcgtagccagcctgtaaatacttgatgcattcgtttcctcagtgctgcaatacatcgtggacttaaacatcttatttatctgataaactcagccttaccttgtggaatctgaagattgaaatatccaaaggtttaaacaagatggaaatcaatgaaaaagaggccttgtttatatatgggtagcttcacatttaatttataaagttaacaatctggaaactgtgagcccataaaacagtattttttagaagttgtgttacaactgtagcaaattttccttttaaaaaatccaggcaatggcattaaacattcttgctatcatttaccatggatttcctacatttctgagatccctgtattcaaaaacaaatgacagggttgttaagttgtactatattaaacaacttggtctggtttatatcattttaacaagttttttggaaatgtaaaagaaaaaagtaaagctccatttttgtgaattgcattgtttctaaaggaagtattttgagtattttcatctgtttgtattgtttcgactatgatatcagatatccagtgtgtccattctggcagtggttttgagttacttcatggaacttggacatacaccaccaggtcctttatgtgttgttctcctgggagacttctttttttaaatgccagggctacttctgctttacctcagtggtatcagcacattgtaaattacgttaaaacacacaactcactgtgatctatgggagtgatatcaaatacaaacgatgttgtgttccttctctcgaacaaaacagcaaagggaatgccagctaacttctttgattagaaggtaatgtcatggaatagaatgctgtcaccagaaaatgctctcccactgctagataaatgcagaggcaaagtgtagacatctgtaggaactaaatatcaaggaaatcaagacatttattttcaaagcgagaattctatctacattctattctgcggatgttatttctgttatacatctgaattttaaaatgtttactgatagataatggatttaaagggcggctaattgattgtctgccattgttgataaactgttctaattggtttgtgaaagaactctgagaattagctaaatggaggctagtgtatttatttttagaggtacatgttttaagtaaatgtatttaaaacaaattttcatggtctgaattgtatatgtaaatgcatatctgtgtaagtatatgcaagtgtatattcttctactgattcagtcagacacgaaatccaactgaattacccggtagactgaatatctgacgggatttctatatggacatagcacagatgaaccaaaaatgtatttatattcacctgagttttaatgtttttaaacaaagttttctcctgcagtgcttttctatatgaaatagttgagtcaagcttgggcttttttcttcgttgttcccaagtcatgtaatgtatagtgaatttatccaaaacgccattgtaacgttttttactagagtgtttttgcacatttgggcgctaaagggattaaaacaactgatgccacaatgactattgaaggagggaaaattctcaaggttccatagtatcttttacaaaatggattaaaaaaaaaatgcctatgcaacttcaaatagtctgatgcctgcttccccaggacgagtgactcttccacggtgtgctgctttccctccgagcctgtggaaaggcagagcccttttgcagatacgaaagcaagcttttgccaatgatctttaatggagttaaaatgtttatggtaattgtaacctttcaaatgagttacgtgaaaagagcatctcacttttaatacacccagatattttcttcaagtctttgtgcattttagcaggacttaattttcttaatttattctttcctttcaattatagtgacatagagtagttggccttataagtagatcccatttagcccctgaacataataccatctgcagtattataaaagtcatttagaaggtcagggggataatctagaggcaggattttggacattgtgaaggaaatgtgctccttctcagctcacttcaataactattttctgagactgaagttttttagacaagaataagaaaactttgctttcttcagttatcacatgtgaaagcttttgctttttgttaggaaaaggtgtggatgactctactgcgtggatggttacatttgctttccgtgaaatgctcagaaaatgtcaggacattccttttccaattgtgtgtcagtgcgtattgtaataaaactactgatttaaatta

SEQ ID NO: 177983 - DNA, 1374 bp, Homo sapiens
  Payload ID: 14912
  Gene Symbol: RNGTT
  Gene Name: RNA guanylyltransferase and 5'-phosphatase
  Uniprot ID: O60942
  ENST ID: ENST00000538899
  CDS Start-End: 1-1374
atggctcacaacaagatcccgccgcggtggctgaactgtccccggcgcggccagccggtggcaggaagattcttacctctgaagacaatgttaggaccaagatatgatagtcaagttgctgaagaaaatcggttccatcccagcatgctctcaaattacctaaagagcctaaaggttaaaatgggcttgttggtggacctgacaaatacttcaaggttctatgaccgaaatgacatagaaaaagaaggaatcaaatatataaaacttcagtgtaaaggacatggtgagtgccctaccactgagaatactgagacctttattcgtctgtgtgagcggtttaatgaaagaaatccacctgaacttataggtgttcattgtactcatggcttcaatcgcactggtttcctcatatgtgcctttttggtggagaaaatggattggagtatcgaagcagcagttgctacttttgcccaagccagaccaccaggaatctacaagggtgattatttgaaggaactttttcgtcggtatggtgacatagaggaagcaccacccccacctctattgccagattggtgttttgaggatgatgaagacgaagatgaggatgaggatggaaagaaggaatcagaacccgggtcaagtgcttcttttggcaaaaggagaaaagaacggttaaaactgggcgctattttcttggaaggtgttactgttaaaggtgtaactcaagtaacaacacaaccaaagttaggagaggtacagcagaagtgtcatcaattctgtggctgggaagggtctggattccctggagcacagcctgtttccatggacaagcaaaatattaaacttttagacctgaagccatacaaagtaagctggaaagcagatggtactcggtacatgatgttgattgatggcacaaatgaagtttttatgattgatagagacaattcagtatttcatgtttcaaatctggaatttccatttcgtaaagatcttcgtatgcatttatcaaatactctcttggatggcgagatgattattgacagagtaaatggacaggctgttcctagatatttgatatatgacataattaaattcaattcacagcccgttggagattgtgattttaatgttcgtctgcagtgtatagaacgagaaattataagtcctcgacacgaaaaaatgaagactgggctcattgacaaaacacaggaaccatttagcgtcagaaataagccgttttttgacatctgtacttcaagaaagaaatacaaacctggtcgatgtgatgatattttgaaatggaagcctcccagtctgaattctgtggattttcgtctaaaaataacaagaatgggaggagaagggtaa

SEQ ID NO: 177984 - DNA, 1809 bp, Homo sapiens
  Payload ID: 14913
  Gene Symbol: RNMTL1
  Gene Name: RNA methyltransferase like 1
  Uniprot ID: Q9HC36
  ENST ID: ENST00000304478
  CDS Start-End: 107-1369
gccgtcacgcgcaccgtacagcccagtccacgaagggcgccacgggccgtgacgtcactagccgccgacggcgcgctttcgtgacgcagcccgggtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatggggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaataggtgacccacgtggctctgtgtgtttttaaaaattgtccaccaagaagcactttgtgcccagaaagttcctgaagcatcatcctggcagggaggcgcctgctccaccagctggtgggtgtttgtaatcgccaagcaccagctataggtcacagccacatcactcacagctgatcactggttggtggaaaataaactatgagcagcagattacgtta

SEQ ID NO: 177985 - DNA, 727 bp, Homo sapiens
  Payload ID: 14913
  Gene Symbol: RNMTL1
  Gene Name: RNA methyltransferase like 1
  ENST ID: ENST00000574509
  CDS Start-End: 13-345
gtctcagggaacatggcggcgctggtgagacccgcgaggtttgtcgtgcgaccgttgctgcaggtggtccaggcttgggaccttgacgcgaggcgctgggtccgggcgctgcggcggagcccagtgaaagtggtgtttccttccggagaggtggtggaacagaagcgcgctcctgggaagcagccccgcaaggcaccatctgaggccagtgcccaggagcaacgagagaaacaaccgctcgaggagtccgcatcccgcgctcccagcacctgggaagagtctgggcttcgctacgataaagcttatcccggggacaggaggctgagggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgag

SEQ ID NO: 177986 - DNA, 572 bp, Homo sapiens
  Payload ID: 14913
  Gene Symbol: RNMTL1
  Gene Name: RNA methyltransferase like 1
  ENST ID: ENST00000571157
  CDS Start-End: 1-532
accgctcgaggagtccgcatcccgcgctcccagcacctgggaagagtctgggcttcgctacgataaagcttatcccggggacaggaggctgagcagtgtaatgacaatagtaaagtccaggccatttcgggaaaaacaagggaagatcctgctggaaggtcgcaggctcatttcagacgctctcaaggctggagctgtgccaaaaatgttcttctttagccgtctagaatacctaaaggagttgccagtcgataagctgaaaggtgtcagcctcattaaggtgaaatttgaggatatcaaggattggtccgacctcgtaacgccacaaggaataatggggatttttgccaagcctgaccatgttaagatgacatatccaaagactcagcttcagcattcactgcctttattattgatttgtgacaatctccgtgaccctgggaacctggggacaattctgagatctgcagctggggcaggctgcagcaaagtgttactcaccaaaggtaaggacatcaaaggccaggcatagtggctcacactcgtaatccagccctttgggaggccgaggc

SEQ ID NO: 177987 - DNA, 4665 bp, Homo sapiens
  Payload ID: 14914
  Gene Symbol: RPAP1
  Gene Name: RNA polymerase II associated protein 1
  Uniprot ID: Q9BWH6
  ENST ID: ENST00000304330
  CDS Start-End: 118-4299
ctgcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcgattcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacgaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatgcagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtactgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcctggaaa

SEQ ID NO: 177988 - DNA, 5897 bp, Homo sapiens
  Payload ID: 14914
  Gene Symbol: RPAP1
  Gene Name: RNA polymerase II associated protein 1
  Uniprot ID: Q9BWH6
  ENST ID: ENST00000562303
  CDS Start-End: 104-4051
ggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcgattcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacgaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatgcagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccggaaagaacatcagggggtccagaggcagccgacttctctgaccagctgtcgttaggaagcagcagggtccctcggtgtgggcaagggactctgctggctcaggcctgccaggacctccccagcatccgcaactgctacctgactcattgctcgccagcccgagccagtctgctggcctcccaggctctgcaccgaggggagctacagcgagtcccaaccctgctactgcccatgcctacggagccgctgctgcccaccgactggcccttcctgccactgattcgcctctaccaccgggcttcagacaccccctcgggactctctcccacagacaccatgggcacagccatgcgggtcctgcagtgggtgctagttttggagagctggcgcccccaggctctctgggctgtgccccctgctgcccgcctggcacggctcatgtgtgtgttcctggtggacagtgagctgttccgggagtccccagtacagcatctggtggcagccctcctcgcccagctctgtcagcctcaagtcttgccaaacctcaacctggactgccgactccctggcctgacgtctttccctgacctctatgccaacttcctggatcattttgaggctgtctcttttggggaccacctctttggggccctggtcctcctgcccctgcagcgtcggttcagtgtcaccttgcgccttgccctctttggggaacacgtgggagccttgcgagctctgagcctgcctctgacccaggtactttctcagcccagcaggacctgcaagggtaccctgcactgggcctcgggggcagtcctgagccttgaggagctttggaagacctcagcttcctcatcttacctcttgggggctttgaggggattaagagaatcaatgaaaagggcttaacatgggctgggtgtggtggctcacgcctgtaattccatcactctgggaagctgaggtgggtggatcacttaaggtcaggagtttgagaccagcctgggcaacatagtgaaaccccatttctactaaaaatacaaaacttagctgggcgtggttgcgggtgcctgtagtcccagctactcaggaggctgaggcaggagaatcgcttgaacccgggaagcggaggctacagtgagccgagatcgcgccactgcaccccagcccagtgacagagcaagaccctgtctcaaaaaagaaaaaaggaaagggtttaacctggtgtctggcatatagtgggtattcattactattaataaggcatagctccttgcttatcagtgctacaatctagataagaagagatttactgaaaacctacatagttgtgaattattcagatgctaggtggtatcaggattcagagaagggaaagatcaaattgggctttgtggaagaagtggggattgacccaggcactgtaggttgggtagaatttgaattggtgaggaggtagaaaggcaggagattcctaacagaataacataagcaaaaggagcatgacaaagggcagaaggagggaggagagatttctgttgggaacttaaggctggtcttgaattcctaatttcgtgtgatccgcctgcctcagcctcccaagtgctgagattacaggcgtggcccactacacatggccaatttcatgctttttaatggctgcttctcagttcccagttttccccaacatctgctctgtagtctttaaccctgatccttgtgctagaaggacagatgtttgtctaggacctgatctctgccctcatgatttggtttcatgtgatcgttatccacacaccttatgtatgtatatacattcctaccctccccctcagcacgtcatttcccctgtcacagttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagtaagttacatctccatcttcagaggaaggaagggagctagcaattgagctgcctctgggccagctggggaagaggtaagtgtcaagcaaggccagtggtgggtaccagccctcggctcagtgccacctctccctgttctgcttctaggatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtactgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcctgg

SEQ ID NO: 177989 - DNA, 955 bp, Homo sapiens
  Payload ID: 14914
  Gene Symbol: RPAP1
  Gene Name: RNA polymerase II associated protein 1
  ENST ID: ENST00000567866
  CDS Start-End: 415-955
aagatggcggcgcccagacaggcctggagcacgtaggtggcggggctggagggacggatttcaggtgatctgggaggaggacccagggtagcgtgtccagtttctttgctggaacctgcctgcgggcctttggtctgtaagggagcaactgtggcctcctctgtgcatagatctcgggcacggcccttcaacgggcggcgaaagctgcgactcgatgattcctcattgtagagttgggtggtccaggaggcttaactggagcccttgacctgagcggtaagggcagtcacgcgtcccgactcgggattggatcctggctctggaggataggctgcaatggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagg

SEQ ID NO: 177990 - DNA, 545 bp, Homo sapiens
  Payload ID: 14914
  Gene Symbol: RPAP1
  Gene Name: RNA polymerase II associated protein 1
  ENST ID: ENST00000566863
  CDS Start-End: 160-545
aacgcgatctctgcggggcaagatggcggcgcccagacaggcctggagcacgtaggtggcggggctggagggacggatttcagggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgcttt

SEQ ID NO: 177991 - DNA, 3906 bp, Homo sapiens
  Payload ID: 14914
  Gene Symbol: RPAP1
  Gene Name: RNA polymerase II associated protein 1
  ENST ID: ENST00000561603
  CDS Start-End: 116-3502
gcggggcaagatggcggcgcccagacaggcctggagcacggatgaataagagggaacccccacacggagacactgctggagagagtcgtactggggaggcagctggagcagcaagatgctgtcgagaccgaagccaggggagtccgaggtggacctgctgcacttccagagtcagtttctcgcagctggtgcagccccagcagtgcagttggtgaagaaaggaaataggggcggtggtgatgccaactcagaccggcctccgctccaggaccatcgggatgtggtgatgttggacaatctcccagatttgcccccagctttggtcccttctcctccaaagagagccaggcccagccctggccactgcctgcctgaggatgaggacccagaagagaggctgaggaggcatgatcagcacatcactgctgtcttgactaagattattgaacgagatacaagttcagtggccgtgaatctgcctgtgcccagtggtgttgctttccctgctgtgttccttcgctcgcgggacacacaggggaaatcagcaacatctggtaagagaagcatctttgcccaggaaattgcggcaaggaggatagctgaagccaagggcccatcagttggggaagttgtgcccaacgtgggcccaccagagggtgccgtgacctgtgagacacccactcctaggaaccagggctgccagcttcctgggagcagccacagctttcagggacccaatctggtcacagggaaggggctcagggatcaagaagctgagcaggaagcccagactatccatgaagagaacatagcaagactgcaggccatggctcctgaggagatcctgcaggaacagcagcggttgctggcccagcttgaccccagcttggttgctttcttgagatctcacagccacacgcaagagcaaacaggagagacagcctctgaggagcagaggccaggaggaccctctgctaatgtcaccaaggaggaacccctcatgtcagcttttgccagtgagcccaggaagagagacaagctggagccagaagccccagctctggcattgcccgtgacccctcagaaagaatggctgcacatggacactgtcgagctggagaagctccactggacccaggacttgccccctgtccggcggcagcagacacaggagaggatgcaggctcgattcagtcttcagggagaactactggcccctgacgtggacctgcccacccacctgggtctgcaccaccatggagaggaggcagagagagcggggtattccctacaggagctgttccacctgacccgcagccaggtttcccagcagagagcactggcactgcatgtgttagcccaggtcatcagcagggcccaggctggtgagtttggggaccggctagcaggcagtgtcttaagcctccttttggatgctggtttcctcttcctactgcgcttctccttggatgacagagtggatggggtcattgcaaccgccatccgtgctcttcgggctctgctggtggctcctggagatgaggagctcctcgacagcaccttctcttggtaccatggagctttgacgttccctctgatgcccagccaggaggacaaggaggatgaggacgaggatgaagaatgcccagcaggaaaagcaaaaaggaaaagccctgaagaagaaagccggcctccacctgacctggcccgacatgatgtcatcaaggggctcctggctaccagcctgctgcctcggctgcgctacgtgctggaggtgacatacccaggacctgcggtggtccttgacatcctggctgtgctcatccgcctggcccggcattccctggaatcagccacaagggtcctggagtgccctcggctgatagagactatagttcgagagttcttgcccaccagttggtctcctgtgggggcagggcctacccctagtctatacaaagtaccctgtgctactgccatgaaactacttcgtgtcctggcctcagctgggaggaatattgctgcccggctgttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctggagccagcaaccaagctcatgcccggaggattggctccaggacatgcagcgcctgtcagaggagctgctgctgccactgctgagtcagcccacactgggcagcctgtgggattcccttaggcactgctcccttctctgcaacccgctgtcctgtgtgccagcccttgaagctccccccagcctcgtgtcactgggctgctcgggaggctgcccccgtctcagtctggctggctcagcctcacccttcccattcctcactgccctcctctctcttcttaataccctggcccagatccacaaggggctgtgtggccagctggctgccatattggctgccccgggactccagaattacttcctccagtgtgtggctcctggggctgccccacacctcacacctttctctgcatgggccctgcgccatgagtaccacctgcagtacctggcactcgctctggcccagaaagcggcagcgctgcagccactgccagccacccatgctgccctctatcatggtatggccttggccctgctgagccggctgctgcccggaagtgagtacctcacccatgagctgctgctgagctgtgtattccggctggagttcctcccttgcctgtgtccctggagtgttacacagtgcctcctgaagacaacctggccctccttcagctctacttccggaccctggttactggtgcgctccgcccacgttggtgccccgtgctctatgctgtggctgtggctcatgtcaatagcttcatcttctctcaggacccacagagctcagatgaggtcaaagctgcccgcaggagtatgctgcagaaaacatggctgctggcagatgagggtctccggcagcacctcctgcactataagcttcccaattccacgctcccagagggctttgagctctattctcagttgccccctctgcgtcagcactacctccagagactgacttcaacagtgctccaaaatggggtatcagagacctaggatagttgatatagatggaaagatgggtacgttgtcctgtatccagcctttcaacagatgtctggccagacgaagaacattgtgtcctaatggtaggcaggagaccaaggagcagaaggcttgccttcctgggagcaggttgtttgagctgttttagagcagtgagccctaccattacatcctgatatctggggcttctgaaggtctgtactgggagtgaagagtggcttagctatttacccgctctttggggacagggcaaactaaatgcatcccttcttacctaactcccaacccctgccctgggctgaggcatatgaatgctatagttgtgcattaaaataaatgttttttatctcctggaaa

SEQ ID NO: 177992 - DNA, 601 bp, Homo sapiens
  Payload ID: 14914
  Gene Symbol: RPAP1
  Gene Name: RNA polymerase II associated protein 1
  ENST ID: ENST00000565035
  CDS Start-End: 1-601
agtaccctgtgctactgccatgaaactacttcgtgtcctggcctcagctgggaggaatattgctgcccggctgactgtgcccatttccagttgagcagctttgatctccggagccgcctgtgccgcatcatagctgaggctccccaagaactggccttgcccccagaggaagctgagatgctgagcaccgaggccctccgtctgtgggctgtggctgcctcctatggccagggcggttacctttacagggagctctacccagtgctgatgcgggccttgcaggtggtgccgcgggagctcagcacccacccacctcaacccctgtccatgcagcggatagcctcactgctcactctcctcacccagctaaccctggcagccggcagtacccctgctgaaaccatcagtgattctgctgaggccagcctctcggccaccccttccttagtcacttggacacaggtgtctgggctccagcctcttgttgagccgtgtctaaggcagaccttgaagttgctgtccagacctgagatgtggagagccgtgggcccagtgcccgttgcctgcctgttgttcctgggagcctactaccaggcctgga

SEQ ID NO: 177993 - DNA, 16993 bp, Homo sapiens
  Payload ID: 14915
  Gene Symbol: RPAP2
  Gene Name: RNA polymerase II associated protein 2
  Uniprot ID: Q8IXW5
  ENST ID: ENST00000610020
  CDS Start-End: 110-1948
ccggcgtcttagcccgctcttctggccccgccccgcgctacgcgtagggaggcggggcctcggggcgagacgccggagcgtgtccccgtccggcagactactctcccccatggcggacttcgctgggccgtcttctgccggccgcaaggccggggctccccgctgctctcgaaaagccgcaggtactaaacagacaagtactttgaaacaagaagatgcttctaaaaggaaagctgaactagaagcagctgtgagaaagaagattgaatttgagagaaaagctctacatattgttgaacagcttttagaggagaatattacagaagagttcctaatggagtgtgggaggttcattacacctgctcactacagtgatgtcgtggatgaacgttctattgtcaaactctgtggttatcctttatgtcagaagaagctgggaattgtaccaaaacagaaatataaaatttctaccaaaaccaataaagtctatgatattactgaaagaaagtctttttgcagcaatttttgttatcaagcatctaagttttttgaagcacaaattcccaaaactccagtatgggttcgagaagaagagaggcatcctgattttcaactgctaaaggaagaacaaagtggccattctggagaagaagtacagttatgcagtaaagccattaaaacatcagatatcgacaatcctagccactttgaaaagcaatatgaatctagttcttctagcactcacagtgatagtagcagtgacaatgagcaagactttgtttcctccattctaccaggaaacagaccaaattcaacaaatattagaccacagctgcaccaaaaaagcataatgaaaaagaaagctggtcacaaagctaactccaaacacaaagacaaagaacagacagtagtagatgtcactgagcagttaggcgattgcaaattagatagtcaggagaaagatgctacatgtgaacttcctttacagaaagtaaatactcagagttcttcaaatagcactttgcctgaaagattaaaagcgtcagaaaattctgaaagtgaatacagtaggtcagaaataactctagtaggcataagtaagaaaagtgcagagcattttaagagaaaatttgccaaatcaaaccaagtgtctaggtcagtgtctagttcagtgcaggtgtgtcctgaagttggaaagagaaacttacttaaagttttgaaggagactttgattgagtggaagacagaagaaacattgaggtttttgtatggccagaattatgcttctgtgtgtctgaaacccgaagcctctctggttaaagaagaacttgatgaagatgacataatctcagatccagatagtcatttccctgcctggagggaatctcagaacagcttggatgagtctttaccttttaggggctcaggtacagccattaaaccactgccaagttacgagaatttgaaaaaagaaactgaaaagttaaatctgaggatcagggagttttacagaggacggtatgttttgggtgaagaaaccaccaaatcacaagactcagaagagcatgattccacctttccactgatagactcaagttcccagaaccagattagaaaacgcatcgtacttgaaaagttgagtaaagtgttgcctgggcttctggttcctcttcagattacattgggagatatttacacacaacttaaaaatcttgttcgaactttcaggttaacaaatagaaatattatacacaaacctgcggaatggactttaattgctatggtgttgctgtcattactgaccccaattcttggcattcagaaacattctcaggaaggtatggtgtttacacggtttctagacaccctccttgaagaattacatctaaaaaatgaagaccttgaaagtctaaccatcatatttagaaccagctgtttaccagagtgatatattccatgaagacaaaatagaagatgaacttctattcaccgtttctggaattctagccgccatgatggtctggtggtgactgataactagttttattccaagacatacctttacctctttaagtttcaatctcccatctcccagtccttcagtccccaactgcagaggatgacctccccagatagaggagaatcattactccaacaagaataaccaagtctttgtatccctagtacaagacatagtatttttattcgaaaatgaatgtttaagtattaaattgaaacttgaatgaatattcaagaaaatataatgatctctactttttctggatgatttccagccatcatatcagtttgccaaaaaaattgagaaagttatgattttgacctcccaacctaaactctaaattctaaagatcagtaaacaattaggtcaataaatacatacaatttaagatgaagccctttggaagtctagtccaaaacaggaaaatctcagaactttctggactcaaggaaatgctttaaatggaatctgtagtttgtttgcaggagagacaatttctagaatttagattgcttttcaaaatgtttatcaggtaggcaagttagcagttgaggcggaacacagacaacttggggagctttactggaaggccaagaaaatactcttggacactggaggaaatgacagctactaaagcccaatcatggaaaaggaccagaaagcagcccactggaatggggagcttagtgggcaaggaggtagggatataatttctcttcttggctccaccagtaattagctctgtggcccagtcacctaaactttctggacttcagttcaggttgtatggcagtaggccatagaattggctactgccatacaatctctatgggaaaggactgcaaaaactaaattttatctctgtatgggcaaaggctactgtcatcctgttgttggtctggggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaatatcaccaaagagaattaaatacttaggaataaatttaacaaaataagtataagacttgtataacgaaaactataaaacattcaagagggctgggcatggtggctcatgcctttagttctagcactttggaggcagaggcaggaggactgcttgagcccaggagttcaagaccagcctgggcaacaaagtgagaccctgtctccacaaaaaataaaaataaaaataaattgaagatggccgaataggaacagctccagtctacagctcccagcaggatggacacagaagatgggtgatttctgcattttcaactaaagtacctggttcgtctcactgggactggctggacagtgggtgtagcccacagagggttagccgaagcaaggtggggcatcgcctcacctgggaagcgccaaggggtcgggggatttccctttcctagccaagggaagccgtgagtgactatacctggaggaggggtacactcctgcccaaatactgctcttttcccacagtcttcgcaactggcagaccacgaaatcccctcccatgcctggttcagtgggtcccacgcccacagagccttgctcactgctagcgccagcagtctgaaatcgacctgggacgtgggagcttggcggggtagaggtgtccgccattgctgaggcttgagtaggcggttctatgctcacagtgtaaacaaagcagcagggaagctcaaactgggcagagcccaccacagctcagcaaggcctactgtctctgtagattccacctccaggggcagggcatatctgaacaaaaggcagcagacagcttctccagacttaaacgtccctgcctgacagctctgaagagagcagtggttctcccagcaccgcgttcaagctccgataatagacagactgcctcctcaagtgggtccctgacccccgtgtagcctgactgggagacatctcccagtaggcgccgaaagacacctcagagaggtagatgccccactggaacgaagcttccacagtaaggatcaggcagcaatatttgctgttctgcagcctccactggtgacacccaggcaaacagggtctggagtggacctccagcaaactccaacagacctgcagctaaggggcctgtctattagaaggaaaactaacagaaaggaatagcatcaacatcaaaaaaaggacatctacaccaaaaccccatccataggacaccaacatcagagaccaaaggtaggtaaaaccacaaagatggggagaaaccagaccagaaaggctgaaaattccaaaaaccagaatgcctcttctcctccaaaggaacacaactccttgccagcaagggaacaaaactggacagagaatgagtttgacaagttgacagaagtaggcttcagaaggtcggtaataacaaacttctccaagctaaaggagcatgttctaatgcgtcgcaaggaagctaaaaatcttgaaaaaaggttagacaaatggctaactagaataaccagtgtagagaagagcttaaatgacctgatggagctgaaaaccacagtacgggaacttcgtgaagcatacacaagcttcaatagccaattcgatcaagtggaagaaaggatatcagtaactgaagatcaaattaatgaaataaagcgagaggacaagattagagaaaaaagagtgaaaagaaatgaacaaagcctccaagaaatatgagactatgtgaaaagaccaaatctatgtttgattggtgtacctgaaagtgatggggagaacagaaccaagtttgaaaacactcttcaggatattatccaggagagcttccccaacctagcaaggaaggccaacattcaaattcaggaaatacagagaacaccacaaagatactcctcaagaagagcaaccccaagacacataattgtcagattcaccaaggttgaaatgaaggaaaaactgttaagggcagccagagagaaaggtcaggttacccacaaagggaagcccatcagattaacagcggacctctgggcagaaaccctacaagccagaagagaatgggggccaatattcaacattcttaaagaaaagaattttcaacccagaatctcatatccagccaaactaagcttcttaagtgaaggagaaataaaatcctttacagacaagcaaatgctgagagattttgtcaccaccaggcctgccttacaagagctcctgaagtaagcactaaaatggacaggaacaaccagtaccagccactgcaaaaacatgccaaatggtaaagaccatcaacactatgaagaaactgcatcaattaatggatgaaataaccagctagcatcataatgacaggatcaaattcccacataacaatattaaccttaaatgtaaatgggataaatgccccaattaaaagacacagactggcaaattgaataaacagtcaagacccatcagtgagctatattcaggagacccatctcatgtgcaaagacacacataggctcagaataaaaggatgtaggaagatttaccaagcaaatggaaagcagaaaaaagcaggggttgcaatcctagtctctgataaaacagactttaaaccaacaaagatcaaaagagacaaagaaggtcattacataatggtaaagggatcaattcaacaagaacagctaactatcctaaatatatatgcacccaatacaggagcacccagattcataaagcaagttctacaaagagatttagactcccacacaatattaatgggtgactttaacaccccactgtcaatattagacagatcaacaagacagaaaattaacaaagatatccaggacttgaactcagctctggaccaagcagacctaatagacatcgacagaactctccaccccaaatcaacagaatatacattcttgtcagcaccacatcacacttattccaaaattgaccacataattggaagtaaagcactcttcagcaaatgcaaaagaacagaaatcacaacaaaccgtctcagaccacaatgcaatcaaattagaactcaggatcaagaatctcactcaactgcacaactgcatggaaactgaacaacctgttcctgaatgactactgggtaaataacgaaatgaaggcagaaataaagatgttctttggaaccaacgagaacaaagacacaatgtaccagaatctctaggacatgtttaaagcagtatgtagagggaaatttatagcactaaatgcccacaagtgaaagcaggagtgatctaaaatcaacaccctaacatcacaattaaaagaactagagaagcaagaccaaacaaattcaaaagctagcagaaggcaagaaataactaagatcagagcagaactgaaggagatagagactcaacaaacccttcaaaaaatcagtgaatccaggagctagttttttgaaaagatcaacaaaattgatagaccgttagcaaggctaaaaaagaagaaaagagagaagagtcaaatagatgcaataaaaaatgataaaggggatatcaccactgatcccacagaaatacaaactaccatcagcgaatactataaacacctctacacaaataaactagaaaatctagaagaaatggataaattcctcgacacatacaccctcccaagactaaaccaggaagaagttgaatctctgaataaaccagtaacaggttctgaaattgaggcaataattaatagcctaccaaccaaaaaaagtccaggaccagacggattcacagccaaattctacgaaaggtacaaagaggtgctggtaccattccttctgaaactattccaatcaatagaagaaaagggaatcctccctaactcattttatgaggctaacatcatcctgataccaaagcctggcagagacacaacaaaaaaagagaattttaggccaatatccctgatgaacatcgatgcgaaaatcctcaataaaatactggcaaaccgaatccagcagcatatcaaaaagcttatccaccacgatcaagtcagcttcttccctgggatgcaaggctggttcaacatatgcaaatcaataaacataatccatcacataaacagaaccaacggcaaaaaccacatgattatctcaatagatacaaaaaaggccttcaacaaaattcaacagcctttcatgctaaaaaccctcaataaactaggtattgatggaatgtatctcaatataataagaggttatttatgacaaacccacagccaatagcatactgaatgggcaaaagctggaagcatttcctttgaagaccagcacaaggcaaggatgccctctctcaccactcctattcaacatagtattggaagttctggccagggcaatcaggcaagagaaagcaataaagcatattcaaataggaagagaggaagtcaaattgtctctgtttgcagatgacatgattgtatatttagaaaaccccatcgtctcatcccaaaatctccttaagctgataagcaacttcagcaaagtctcaggatacaaaatcggtgtgcaaaaatcacaagcattcctatataccaataatagacaaagagccaaatcatgagtgaactcccattcacaattgctactaagaaaataaaatacaaagcactgctcaaggaaataagagaggacacaaacaaatggaaaaacattccatgctcatggataggaagaatcaatatcatgacaatggccttgttgcccaaactgatttatagattcaatgctatccccatcaagctaccactaactttcttcacagaattggaaaaaactactttaagattcatatggaaccaaaaaagagcccacctagccaagacaatcctgggcaagaagaacaaagctggaggcatcacactacctgacttcaaactttactacaagcctacagtaaccaaaacagcatggcactggtacaaaaacagatatgcagacgaatggaacagaatggaggcctcagaaataacaccacacgtctaccaccatctgatctttgacaaacctgacacacacaagcaatggggaaaagattccctatttaataaatggtgttgggaaaacgggctagccatatgcagaaaactgtaactggaccctttccttacaccttatacaaaaatcaactcaagatggaacaaagacttaaacgtaagacctaggaccataaaaatcctagaagaaaacctgggcaataccattcaggacataggcatgggcaaagacttcatgtctaaaacaccaaaagcaatggcaacaaaagccaaaattgacaaatgggttctaattaaagagcttctgcacagcaaaataaactatcatcagagtgaacaggcaacctacagaatgggagaacatttttgcaatatatccatctgacaaagggctaatatccagaatctacaaagaacttaaacaaatttacaagaaaaaagcaaacaaccccatcaaaaaatgggcaaaggatatgaacagatacttctcaaaagaagacatttatgcagccaacagacatatgaaaaaatgctcatcatcactagtcattagagaaatgaaaatcaaaaccacagtgagataccatctcatgccagttagaatggcgatcattaaaaatcaggaaacaatagatgctggagaggttgtggaaaaattggaacgcttttacactgttggtgggagtgcaaattagtccgaccattgtggaagtcagtgtgacgactcctcaaggatctagaactggaaataccatttgacccagcaatcccactattgggcatatacccaaaagattataaatcattctacaataaagacacatgcacacgtatgtttattgctgcactattcacaatagcaaagatttgaaaccaacccaaatgcccgtcaatgatagactggattaagaaaatgtggcacatgtataccatggaatactatgcagccataaaaaaggatgagttcatgtcctttgcagggacatggataaagccggaaaccatcattctcagcaaactatcacaagatcagaaaaccaaacaacgcatgttctcactcataagtgggagttaaacaatgagaacacatggacacagggagggtaacatcacacaccagggcctgtggggggtggggggctaagggagggataacattaggagaaatacctaatgtaggtgacaggttggtgggtgcagcaaaccaccatggcatgtgtatacctatgtaacaaaactacatgttctgcacatgtaacccagaacttaaagtataataaaaaaaataattattaaattttaaaaaactagccaggcatggtgctgcacacctgtagtcccagctacttgagaggctacattgggaggattgcctgagcttgggaggttgaggctgcagttagctgtgactgtgccagtgcactccagcctgggcaacagagcaagaccctgtctcaaaaaaagaaaaagaaaaattcagagagattaaagaaggtatcaagaaatgtagacacaatccatgttcatgaattggaagatcaaatgttgttaagatagcagttctccccaaattaatctacaatgcaatccctatcaaaatcacagcaggcttttttgaaaaattgacaagccaatcttaaaatctgtatgaaaacataaaggattcagaatagccaaaataattctgaaaatgaagaaataattctgatccagaacttactacaaagctacattaatcaagacagtgtggtactgatataaagataggcatacagatcagtggaacagagtccaggaataaaccttcacatttatgatcaattaagttttgacaaaaatcccaatgaaattatggagaaaagatggtcttttcaacaaatagtgctaggatatttggatatcaaatgcagaagaaattaatttagattcttacctcctaccatatgcaaaaataaactcaaaattgatcacacacctacatgtaagagctaaaactataaaacatgtagaagaaaacatgggagaaaacctagatgaccttggtttaggaagaattcttaagacactaatagcacaattcataaaagaaaatattaataaattggacttcattaaaatataaaattttgtttcaaaaaactattaagaaaattaattggcccggggaggtggttcacatctgaaatccctgcactttcggaagccaaggagggtggaccacttgagctcaggaatttgagaccagactggacaacagagcaaaatgccatctccacaaaaaatacaaaaattaaccaggcatggtggcgtgctcctgtagtcctggctactcagaaggctgaggtgggaggatctcttgaccctgggaggcagaggttgcagtgagccaagatcacaccaccgcactagagcctgggtgacagagtgagaccctgtctcaaaaaaaaaaaaaaaaaaaaaaattaattgaaaaatcacagactgggagaaaatattttcaaaccataataagtatctgatagaggacttgtatctagactatgtaaagaattcttaaaactcaaaaataaggcagacaacttaaaaatggacaaaatgtttgaatagatatttcagcaaagatatacaaattgcttagcatatgaagagatgtgtactatcactagtcattaggaaaatacaagttaaaagcaaaattagataccattttggacccactaaaatgactataataaaaaagacagacaaagatatgtgttggtgatgatgtggagaaactggagccctaatgcattgctggtgggaatgtaaaatggtgcagccactttggaaaacagtttggcagtttcttaaaaagataaacataagtttaccatatgatcctgctattccatgagaagagaagtggaaatgtgttcacatcaagactcgtaggcaaatgttcatagcattatcattcatattagtcaaaaagtggaaaccaaatgaccatcaactactggattttttttttttttttaagagatgaggcctcactatgttgcatactctgaagtcaaactcctgggctcaaacaatcctcctgcctcagcctcctcagtaactgggactgcaggcaggcaccaacatacccagattatttctttttctttttttttttaactggtggatttctttaaatgatatatgtatacaatggagtagtgatataggctacaatatggatgcatctcaaaacattatgcttagtgaaagaagtctgatgcaatatcccacatatggtatgtttccatttacagtccagaaaaggcatatactaaattagcagttgcatgggtctgatgtgaaaacatggattgcctgcagatgggcacaagggatcttttgggggtgacaaaaatgttccaaaactaagttgtaatttttgcacaacttttatgtgtgtgtgtgtgtgtgtgtgtgagatggagtttcactcttgttgcccaggctggagtgcaatggcgcgatctcagctcaccacaacctccgcctcctgggttgaagcatttctcctgcctcagcttcctgagtagctgggattacaggcatgtgccaccatgcccggctaattttgtatttttagtagagacaggttttctccaggttggtcaggctggtctcgaactcctgacctcaggtgatcctcctgcctcggcctcccaaagcgctgggattacaggcgtgagccaccacacccagccatttttgcacaactttataaactttaaaaataattgatttatgcacttaaaacaggtaaagtttatgtgtataaattataccttaataaagctattaaaagtcaaagattataacagggcctctctctctctgacctagtgacctagggtaaagagaaaaagaagctagccaggcacaggggctcacacctgtaatcccagcactttgggaagccaagatgggctgattgcttgagtccaggagtttgagaccaacttgggcaacatagcaaaaccctgtctccaccaaaaataaaaaaaattagccaggcatggcggtgtatgcctggagtcccagctactcaggagtcagaggtgggaggatcacttgagcccaggaggcagaggttgtagggagccaagattgcaccactgcactccagcctgggtgacagagcaagacactgtctcaaaaattaaaaattaaaaaatgagggaagctgctgtatctccacttcttccctctctgtgcccagagatatctcttcagttatctcacatgccctacaagtctagagacctcaggtgaggagccagtagctcagtatagaaactaaggatccaagtggacaactgccaccaagtcaccacagggccagctgctttgggagggtgctgcatctgcctcccatacacttctgccaagtttatgttagtttgggaggactgaagcagaattcagttcaaagtactgtgctggattttggtttctaaatattttccaatagaaaagaacccaggcttcttgagaaaatagctaggttctaaggctagagccaaaaaaatgcaagataagcctggagcatcttgtagtaccagaaactaagcaagtgctcaaaaacaaaaggatagaagcatgtcagacagacacaggagccaatctgaaagagctccctggccgggcacggtggctcacgcctgtaatcccagcactttgggagactgaggtgggaggatgacttgagcccaggagtttgagaccagcctgggcaacatagggagaccccatctctacaaaaaagtaaacaattagccgggcatggtggcacacgcctatagtcccagctactcaggagggtgaagatcacctgagaccaggcggtcaaggcttcagtgagccatgattgtggcactgcactccagcctaggcaatagagtgagactgtctcaaaaaataaaattttaaaataactgaagagtataactggattgtttgtaacacaaaggataagtgcttaagatgatggaaaccctatttatcctgatgtgattattacacattgcatgcctgtaccaaaatatttcatgtaacccataaatatatacatctactatgtacccacaaaaattaaaaaatgtttacaggagtgaaccaccgcacctggccagtggagtctttttaaggtattatttagcatcttctgcttatagtcatgtccaaaaaccagttgatcttcctactcattaggggacaagatcaattctctaaaaaattaacctagcccaaggtaagtggtactattctgaaatctgaaaatctttagtagcctcacattataagcccttcgtagaaaaagaaaagtaagcatttctagaagcacatttttgttggactgagggtggggcaaggagcaggggtgactttcatctgaaatgtacctaggcaggccagagtctgagttaggactggctcctgggactttgccatccaggccaagaagcatgctccagtgtgcatgcactctcatcaaagccctagtcaggaatcccagccactcctctcctgtgcagcacaagctgaaggataaggtgtggggcagtgactgcgtggggctgcctgtgtgattcctgataaagaaatgccttcatgaaatgtattgttccccaataaagctcattttctgtgagaattcatgtgtccttttccaaattaaactagcaaaatatgaacttttgtaaaaggtccacacccagccagttttctactctctaaatgttcaggcctttgcctgtccttccctcagcaaaaatactgtgttttggaaaacattaccaataaaggagctgggaggtggaattggatcaaaatacctttagatgaaagcagcagcacaagccattccctttaaatgagctggcctcacctctggggcctatgaagaaaagcctgcttcaaggtgatagttttcattttgcttcccagcacctctgcagtcataaccaaagtgaaggacaatattgcatgacttcagaagaaagccatccagccaccttgcaacatgttcaggaaattctggactcccttggggcttgcaaaactccctatgtcttgcagaccaaaagcaagttctcagtcacctagctctagtttgcataattaaagaaagtggaagctggttcttttctgggtgacccttcacccaaccaagctcataaggacttgtgacaaaaataagagcaataaaatgaagttttaacagtgaaaacttctatcacttagataagcaggaaaagccagtcccctagatgcccatctgaccctaccttactggggtcatacagccaaagcagtgtccacttcaggtactgtaatgttttgaagttgacacatataatttaatgtagtttcatgtcataagttataagacttttcagagaaacaatttagtaatatcttctgtaatacccatcttcattttttatatgaaaaagcatagcctatgatctgtcaccttgctcactcccacatccttacctcttatccttctcacatcgtcccattaacacattatccatctttggggggaaaaaatacactaaattttagacagagtcactttcactatggccacaatgggagaaaagacagtccaccttcaaagtcaaccagaatgactcttaacctctcttgtctgggttgggcatccagataagattttcttcgtacaaagagtcttgctactaggaaaaagagtttgaaaatcactagtctaactaaatatctcactttaaaaaaagcacaaactaagactcaatgaggtttatcttccacaagatcagccagttttagcagagcagttgctaaaacccaggtctcaaactccttgtctatggctcatctaactaagcaacaaaaagcccaatgagctctggagagagagagggagctaaaacaggactcaatcaaaacccacttgggattagggaagccaccctctgtgagtgagttaaactgagattccctccccttcaccctggcttcctttgcagaacaagggtcaccgccagagggaaagctgagtttacggaggggatcctggttggagtcagagtataccttggtttggttttgtggggttttttgagacagggtctcactgtcacccaggctggagcacagtgacagtcatagctcactatagcctcagactcctggcctcaagcgatcctcccacctcaacctccagagtatctgggactataggcacgtaccaccatacccagctaatattttttttaattttatattttttagagacagggtgtcactatgttacccaggtctcaatcactatgttactccttgcctcaagcaatcctctcaccttggcctcccaaagtgctgagcttacaggtgtcaaccactgtggccagccacgcattggttttaaggtccagaatttttctgtttggagccttcacaattagttttaggttgggagaccgtgaacccaccaagcagccctttagaggctggaaaaagagtttggaaaaagaactctgtggctttaggaatttctctcggaaatcctctagggcagagaaggaaaatttaccaaatgggagagtgtattagtctattcttacattgctataaggaaataccccagactgggtaatttataaaggaaagagttttaattgactcacagttccacatggctgggaaagcctcaggaaacttacaatcatagcagaaggcaaaggggaagaaaggcaccttcttcacagggcggcaggaaggagaagtgcagagcaaagtggggcaaagcctctataaagccatcagatctcatgagaactcactatcatgagaacagcaggggagaaccacccccatgatccaatcaccttccacgaggtccctcccccaacacgtggggatcacaatttggattacaattcaagatgagatttgggtgaggacacagagccggaccatatcagagagaaagctattactgaagacctttctaactcacttctgtaaagatcaattcaataaaagcagcaaacacacatactttgctttccttgtgattaatgccttgacttttttgtggaaagtaacaccccaagaaagccagctactcatgttggcaataaaggtaaaagtatctatggaataaggaccatttttaggacaatactttccctactacttagttctagtcccttttttgtagaattctgaggactttctacatacacaatcatgtcatcagcaaataaagattattgtacttgttctttgccaacccatatgtcttgccttactgccctggttaggaccttcagaacaatactggatataagtggtgaaagcacatatcctccccttgttcctaattttagagggaaagtactcagtctttcgccattaagtacaatgtcagctgtaagttttcctagagaccctttctcagcttgaagatgttccctggtattcatagtttgctaaaaggtttttgtcattttaaatcataaatgggtgttgaattttgtcaaaggcttttaatgcatctatggagatgatccaagtttttttcctccttatttctgctaaggttgtataattatgctcattggtattttaaatgttaaattaaccttgcgttcctgggataagacccactgatcatgatgcattttcctctttgtaaattgctgtattcattttagtttcttcaggattttgcctatgtttgaaggatattggtttgtaatttttcttgtaacatctttgtctggttttgaaatcaaagtaatactggcctaataaaatgagttggaatgtg

SEQ ID NO: 177994 - DNA, 4370 bp, Homo sapiens
  Payload ID: 14916
  Gene Symbol: RPAP3
  Gene Name: RNA polymerase II associated protein 3
  Uniprot ID: Q9H6T3
  ENST ID: ENST00000005386
  CDS Start-End: 117-2114
gcttgtggggaagcgcaggaggcggggctttgcgtgagtcactgccgggctcggcgtgagtcgctgcggggctgacggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgagatacatttgtaaggatcagcattttattttatgagtcattttaaatgttaaatttagatacattcttcagtgacccataaatgtaacattatttttatattttcatgagtttttgtaaccacttgccaaagctgcttcattagcatatgaataattacctttgtaaagaggaagttaaatagatagtgagatcctttctttataaaacttttaaatgttattgtgccaattcactaacatgaagttatttagttgcagggtatgtatgtatttttagtatttatgttgaaagaaagaagacttttaactagactttcaaactaggttaattgaagtatcacagtattcttacattttaatgccatagggttttttcccttaagatatccatgttacataccagttaaggacagataatctaatgcaaggtgtaaaaatgtaaaaattagtaatgtttaaagtactaattagcatatagcccatatgtatttgttggatgtgagtgtagcgtttgtaaacttttgaaagtagggctagaactctgctcatccctgtactctgcatagtacctagcacagacgtttgcacatagttaggtgctcaactgatacttataaaatttaattgaatttgacgcaagaatcatattaagtaaatgtttaaagtagcagcctagcaaatttttgggcatggtgtaagcactggtaaaaccagttaattttagagactatcaagttgttaaaaaatattaggacaccatcctttaattgttatcagcatcaataagacagttcagtttacaattttatacgatattgtggttaatttttattgccattatacatattactattcttatgaattgtttgagaagtaatcataatttatttacaaagataatttcttcagattgtggtataaattattgagatatgtttgtaatttggatagtttgaatgctttaaaatacacttgatagagtttattaactttgtttattgctaaatgtattatgatatataaacaggcaattgaatttagctttttatctgctatgatctgaatgtttatatcccccacaaattcatatgttgaaatcctaaccctgaaggcgatggtcttcggaggtggggcctttgggaagtgattgggtcaagagggcaggcccttgtaaaagaggccccagagagcttgttcaccaattacaccatgtaaggacacataagaaggcaccatctacgaacaagaaggtgggccttcaccagacaccagagaccagaatctactggcatcttcatcttggactccccatcctccagaactgtaagaaataaatttctgtttttattaatgtaagctacccagtttgatattttattatagcaacccgaatggactacggtatgatcctttgaagaaacttacaaggtagtcagggcaggtaatgttattgtcattcttaacataagaaaaggaggctcagagggttaatgttctctgcatgattatagagctaaaaattggccaaaacagttcagaacgtgctgtcttctcttaatgtagagctatttgaactacttccagctgcagtttttatgttgtgttacctgtgtagagactgttaactgaagaagtacagatcacaagatttactatagaatttgaattttaaaaaatttctgatgttagcctgatttctccccagagacattttcatgtagtgatttaagaccagaggctctggattcagacttcttgagtttgaattctggctccatctggctttagggccttggacaagttacttttctattctttgtttttgaaatctgtagaatgggtataagtgagattgaatgaatgcacacattttgtttttggagcagggctggatgtatagtaagctactgttactattattattacaattaccaacatttcctaaaagtgattagaataaagaacagtctttaggggctgtcatattgttgccttattgcaaaatagcatagtggttaataaagtcatttttgggtcaaataa

SEQ ID NO: 177995 - DNA, 2149 bp, Homo sapiens
  Payload ID: 14916
  Gene Symbol: RPAP3
  Gene Name: RNA polymerase II associated protein 3
  Uniprot ID: Q9H6T3
  ENST ID: ENST00000380650
  CDS Start-End: 42-1937
cggggtggcagtgcggcgggttacggcctggtcagaccataatgacttcagcaaataaagcaatcgaattacaactacaagtgaaacaaaatgcagaagaattacaagactttatgcgggatttagaaaactgggaaaaagacattaaacaaaaggatatggaactaagaagacagaatggtgttcctgaagagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaagaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatga

SEQ ID NO: 177996 - DNA, 2133 bp, Homo sapiens
  Payload ID: 14916
  Gene Symbol: RPAP3
  Gene Name: RNA polymerase II associated protein 3
  Uniprot ID: Q9H6T3
  ENST ID: ENST00000432584
  CDS Start-End: 400-1920
gagtcactgccgggctcggcgtgagtcgctgcggggctgacggggtggcagtgcggcgggttacggcctggtcagaatttacctcctattcgaaatgggaattttaggaaaaagaagaaaggcaaagctaaagagtcttccaaaaaaaccagagaggaaaacacaaaaaacaggataaaatcttatgattatgaggcatgggcaaaacttgatgtggaccgtatccttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggcatggatgccgatccatataatcccgtgttgccaacgaacagagcgtcagcatattttagactgaaaaaatttgctgttgctgagtctgattgtaatttagcagttgccttgaatagaagttatacaaaggcttattccagacgaggtgctgctcgatttgctttgcaaaaattagaagaggccaaaaaagattatgaaagagtattagaactagaaccaaataactttgaagcaacaaatgaactcaggaaaatcagtcaggctttagcatccaaagaaaactcatatccaaaggaagctgacatagtgattaagtcaacagaaggagagcgaaagcaaattgaagcacaacagaataagcagcaggccatttcagagaaagatcgggggaatggatttttcaaagaggggaaatatgaaagagcaattgaatgctatactcgagggatagcagcagatggtgctaatgcccttcttccagctaacagagctatggcctatctgaagattcagaaatatgaagaagctgaaaaagactgcacacaagccattttattagatggctcatattctaaagcttttgccagaagaggaactgcaagaacatttttgggaaagctaaatgaggcaaaacaagattttgaaactgttttacttctggaacctggaaataagcaagcagtaactgaactctccaaaattaaaaaggaattaattgagaaaggacactgggatgatgtctttcttgattccacacaaagacaaaatgtggtaaaacccattgataatccaccgcatcctggatcaactaaaccactcaagaaggttattattgaagaaactggtaatttgatacagactattgatgtgccagatagcactactgctgctgctccagagaataatcctattaatctagcaaatgtaatagcagccacaggcaccacaagtaagaagaattcaagccaagatgacctttttcccacaagtgatactccaagagcaaaagtattgaaaatagaagaagtcagtgatacttcatccctgcaacctcaagccagtttgaagcaggatgtatgtcagtcttacagcgagaaaatgcccatagagatagaacaaaaacctgctcagtttgccacaactgttcttcctccaattcctgcaaactcgttccagctcgaatctgatttcagacaattgaaaagttctccagatatgttgtatcagtatttaaagcaaattgaaccatctttgtatcctaagttgtttcagaaaaatctggatccagatgtattcaaccagatcgttaaaattctgcatgacttttacattgagaaagaaaagccattactcatctttgaaatcttacaaagactttctgaactaaaaaggtttgatatggcagtgatgtttatgtcagaaacagagaaaaagattgcacgtgcattatttaatcacatagacaagtcaggattgaaggatagttctgtcgaagaactcaagaaaagatacggtggttgatttccatttttgctgaaataattgtttttgactttcatatgtaaattttttctactgaaagtgttttgctttttaagaaaatgaaattatatagcaggaaaggactatctttgaacataagttaattaactataaggtgaattgtgatttaactagtgagaattgtattcaagtgaactctgtttttctgaaaataaaaatataaacaatgag

SEQ ID NO: 177997 - DNA, 2050 bp, Homo sapiens
  Payload ID: 14917
  Gene Symbol: RPUSD1
  Gene Name: RNA pseudouridylate synthase domain containing 1
  Uniprot ID: Q9UJJ7
  ENST ID: ENST00000007264
  CDS Start-End: 136-1074
gggcggaagcgctgccaggcgtccggagcggagcttccagggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggctccaagga

SEQ ID NO: 177998 - DNA, 917 bp, Homo sapiens
  Payload ID: 14917
  Gene Symbol: RPUSD1
  Gene Name: RNA pseudouridylate synthase domain containing 1
  ENST ID: ENST00000569601
  CDS Start-End: 375-917
gtcgccagcgcgcgggcgcgcggctggagccggcgccgggcacggcatcgggggcctggactgcacggcccggcagcagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggtgtggcaggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacg

SEQ ID NO: 177999 - DNA, 2159 bp, Homo sapiens
  Payload ID: 14917
  Gene Symbol: RPUSD1
  Gene Name: RNA pseudouridylate synthase domain containing 1
  Uniprot ID: Q9UJJ7
  ENST ID: ENST00000561734
  CDS Start-End: 245-1183
ggcttaggtcaggcagggcccttcaggtcagcccggagcaggctgactccttgactccccagctgacgccctggggactgatctcggggactgaggatgcaggtgcacagtagggctgcggacccggctcggtggcttcgcaccggagcccgggtggggcggtgcgggtacctctgtatgctgggctgggggcgcaccacgtgctcacagcacacgcacccacgcgtggctcggcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttcagtgactggctccaagga

SEQ ID NO: 178000 - DNA, 1835 bp, Homo sapiens
  Payload ID: 14917
  Gene Symbol: RPUSD1
  Gene Name: RNA pseudouridylate synthase domain containing 1
  ENST ID: ENST00000567114
  CDS Start-End: 348-899
cgcgcagcggtgcagggcggaagcgctgccaggcgtccggagcggagcttccagggtctctgggtcgccagcgcgcgggcgcgcggctggagccggcgccgggcacggcatcgggggcctggactgcacggcccggcagcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctc

SEQ ID NO: 178001 - DNA, 587 bp, Homo sapiens
  Payload ID: 14917
  Gene Symbol: RPUSD1
  Gene Name: RNA pseudouridylate synthase domain containing 1
  ENST ID: ENST00000563560
  CDS Start-End: 82-587
cagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggtgtggcaggttgtgagaacccaaagccaagcctcacagatctcgtggttctggaacacgggctgtacgcaggcgatcctgtctccaaagtgctgct

SEQ ID NO: 178002 - DNA, 561 bp, Homo sapiens
  Payload ID: 14917
  Gene Symbol: RPUSD1
  Gene Name: RNA pseudouridylate synthase domain containing 1
  ENST ID: ENST00000565503
  CDS Start-End: 93-386
ctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacagctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacggg

SEQ ID NO: 178003 - DNA, 940 bp, Homo sapiens
  Payload ID: 14917
  Gene Symbol: RPUSD1
  Gene Name: RNA pseudouridylate synthase domain containing 1
  ENST ID: ENST00000565377
  CDS Start-End: 422-940
gcggaagcgctgccaggcgtccggagcggagcttccagggtctctgggtcgccagcgcgcgggcgcgcggctggagccggcgccgggcacggcatcgggggcctggactgcacggcccggcagcagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtgg

SEQ ID NO: 178004 - DNA, 835 bp, Homo sapiens
  Payload ID: 14917
  Gene Symbol: RPUSD1
  Gene Name: RNA pseudouridylate synthase domain containing 1
  ENST ID: ENST00000567283
  CDS Start-End: 86-511
tcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattggtaagacctgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgct

SEQ ID NO: 178005 - DNA, 1918 bp, Homo sapiens
  Payload ID: 14917
  Gene Symbol: RPUSD1
  Gene Name: RNA pseudouridylate synthase domain containing 1
  ENST ID: ENST00000565809
  CDS Start-End: 124-519
tgccaggcgtccggagcggagcttccagggtctctgggtcgccagcgcgcgggcgcgcggctggagccggcgccgggcacggcatcgggggcctggactgcacggcccggcagcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggttctgccaccagctggatttctccaccagcggggcgctgtgcgtggccctaaacaaggcagccgccggcagcgcgtacaggtgcttcaaggagcggcgcgtgaccaaggcttacctggcattggttgtgagaacccaaagccaagcctcacagatctcgtggttctggaacacgggctgtacgcaggcgatcctgtctccaaagtgctgctgaagccgctcacgggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgccctccctggatgcctgctggagcccccacacactgctgcagtcgctggaccagctcgtgcaggccttacgggccacccccgaccctgaccccgaggataggggccccaggccaggcagcccctccgcactcctgcctgggcccggccggcctcctccacccccaaccaagccccctgagactgaggcacagcggggcccctgcctgcagtggctgtcggagtggacgctggaaccggacagctgagagccgtggggctggggcagggggtgtcagctgcacagcgggactctagggagatgggcgagcgagcgtctgctcactggctctggggcctcgaggtgccaggcagcatcaggcccactgggttgccccggccaggcctgcgaggaagggctgaggtggggccggcagggggcgccaggcagccgtgatcacaggtgacgaccgcaccgcggccgtgggactgatgcgggatcccgagggccttcctgcccacatgccccgggagaaaccgaggcccctccctcctcctggaacagcttccggctctcaagcgtcaccccaggggcgtcagttttacggactcaaggtcacctcaggaagaggcagggccaggttttgggataggctttgcctccaggatgggctgctcctgggcctggtgagctactgcccccaacctaccctctagaggggctgggaagggccgttctgggctcacctggcctgggagacccatctggtccctgcgtcctctgcccctcactgctctgtgcagatcctgtcgccctcagctgcctcctcccgagacctaatggtccctgctgggctcgagtctgcaggcccggctgcgtgtgccttggcctcactgtaccagtggttccctctctgcccggattctgagctcagtgtggtgtttggtgcacaggggttggtcaggggccatggccaaggccctgccacgcacgcccatccctcagatccactgtgagcaccaacctgctgcagtctcttgggcccctgctggcagctctgccacgtcaccgcctgcctggctcccacacagccatgcattgtcactctgcctccgggaccccagcttgggagctgtgggtctgccaggtcccacctcctctgtcccccatgccacaacctgggctcctggctacagcagggctccagggactccaaataaatgttca

SEQ ID NO: 178006 - DNA, 954 bp, Homo sapiens
  Payload ID: 14917
  Gene Symbol: RPUSD1
  Gene Name: RNA pseudouridylate synthase domain containing 1
  ENST ID: ENST00000562070
  CDS Start-End: 1-536
accagctggatttctccaccagcggggcgctgtgcgtggccctaaacaaggcagccgccggcagcgcgtacaggtgcttcaaggagcggcgcgtgaccaaggcttacctggcattgctgcgggggcacatccaggagagccgggtaaccatcagccatgccattggcaggaacagcacggagggccgggcccacaccatgtgcatcgagggctcgcagggttgtgagaacccaaagccaagcctcacagatctcgtggttctggaacacgggctgtacgcaggcgatcctgtctccaaagtgctgctgaagccgctcacgggtgtgtctggggtgggcggtgtcctggtggtgacagaagggaaactgaggcacagggccacgaagcttatgttgggccaccctgagcatcagggcagagctggcaacaagcactcctgcgttcttaactccacgccctgcagcctctcagcttctcacctgacacagggtccctgctggctcctgactgattccttgggggtctggctggcctagattctccaggaccgagcaccaccctggccctgtcctcaccagtggtgacctgaacacaatcttctgtcctaaatactgtcatcctcactcatggcaggggacagggagagttccaccccaagaggctgcttcaagactgcagcggggtcatgacgggaggtgggtcctggtcagggagataggtgtggatcggccccgctcccagcttgatccggcaccgccctcatcccgcaggccggacacaccagctgcgcgtgcactgcagtgccctgggccaccccgtggtgggcgacctgacctacggagaagtctcgggccgggaggaccggccgttcagaatgatgctgcacgctttctacctgcgcatccccacggacaccgagtgtgtggaggtctgcacgcctgaccccttcctgcc

SEQ ID NO: 178007 - DNA, 2358 bp, Homo sapiens
  Payload ID: 14918
  Gene Symbol: RPUSD2
  Gene Name: RNA pseudouridylate synthase domain containing 2
  Uniprot ID: Q8IZ73
  ENST ID: ENST00000315616
  CDS Start-End: 39-1676
gatcgcgaccctgggagtggagtgggggcagcgtggttatgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcagctggagaaggagtacgtgtgccgggtggaaggggagttccccactgaggaagtgacctgtaaagaacccatcttagtggtgtcttacaaagtaggggtgtgccgtgtagatccccggggcaagccctgtgagacagtgttccagaggctaagctacaatggccagtccagtgtggtacggtgccggccactcacaggccgcacacaccagattcgagtccaccttcagttcttgggccatcccattctcaacgaccccatctacaactcagttgcctggggtccttctcgaggccggggcggctacattcccaagacaaacgaggagttgctacgggacctggtagcagagcaccaggccaaacagagcctggatgtgctagatctctgtgagggtgacctgtccccaggactcacagactctacggccccctcctcagagttgggcaaggacgacctggaagagttggctgcagctgcccagaagatggaggaagtagctgaggcagcccctcaggagttggacacaatagccttggcatcagagaaggcagttgaaacagatgtcatgaatcaagagacagacccactctgtgcagagtgccggctggtgcgacaggatcccttgccccaagaccttgtgatgttcctacatgccctacgctataaagggccaggctttgagtacttttcaccaatgcctgcctgggcacaggatgactggcaaaaggactgagggtgtggccaatggagggattgcttcttgggttgtgacaaggatgggctatagggcaagggctgaccccatgggctagtacttggggtttctataggaatgaggacgggcttctaaagagacctgctcatacttgctacctccttccagtgggaatttggagactttttggtttgtaaatatatccctttttctaacatctttgatgtctggttttcttccggcttcttttttattactgatgtaaaattcacataacataaaattaaccactttaactagccaggcacagtggctcatggctataatcctagtactttgggaggtagaagtgaaaggatcactggaggccaagagttcaaggttaaagtgaactgtgattgtgctgctgcactccagagcctaggtgacagagtgagaccctgtctcttaaaaaaaaaaaaaattaaccaatttaagatgtacagcgtagtcacatttagtacattcacagtgttgtacaaccataacctcatatatttccaaaacattttcatcaccccaaaaggaaacctgtacccattaagtaagtggtcactttccactccccttccaccagcctctggcaaccactaatctactttctgtctgtttggatttgcctgtttattctggacattttatataaatggaatgataaaac

SEQ ID NO: 178008 - DNA, 1558 bp, Homo sapiens
  Payload ID: 14918
  Gene Symbol: RPUSD2
  Gene Name: RNA pseudouridylate synthase domain containing 2
  Uniprot ID: Q8IZ73
  ENST ID: ENST00000559271
  CDS Start-End: 7-1461
gtggttatgtggctggaccgccgcggatggctcagggttcttggacattggcgctacgaccttaggcgccctagctttaccaggacttggagtggcgataagggcccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggacaatgatttcttgcggaacacagtgcacaggcatgagccaccagtcacagcagagcccattcgcctgctagctgagaacgaagatgtggtggttgtagacaagccttcctccattcccgttcacccctgtggccgcttccgacacaacacagttatcttcatcctaggcaaggagcaccaactcaaggagctacaccccttgcatcggcttgaccgccttacctcaggggtgcttatgtttgccaagacagctgcagtctctgagagaattcacgagcaggttcgggaccggcagctggagaaggagtacgtgtgccgggtggaaggggagttccccactgaggaagtgacctgtaaagaacccatcttagtggtgtcttacaaagtaggggtgtgccgtgtagatccccggggcaagccctgtgagacagtgttccagaggctaagctacaatggccagtccagtgtggtacggtgccggccactcacaggccgcacacaccagattcgagtccaccttcagttcttgggccatcccattctcaacgaccccatctacaactcagttgcctggggtccttctcgaggccggggcggctacattcccaagacaaacgaggagttgctacgggacctggtagcagagcaccaggccaaacagagcctggatgtgctagatctctgtgagggtgacctgtccccaggactcacagactctacggccccctcctcagagttgggcaaggacgacctggaagagttggctgcagctgcccagaagatggaggaagtagctgaggcagcccctcaggagttggacacaatagccttggcatcagagaaggcagttgaaacagatgtcatgaatcaagagacagacccactctgtgcagagtgccggctggtgcgacaggatcccttgccccaagaccttgtgatgttcctacatgccctacgctataaagggccaggctttgagtacttttcaccaatgcctgcctgggcacaggatgactggcaaaaggactgagggtgtggccaatggagggattgcttcttgggttgtgacaaggatgggctatagggcaagggctgaccccatgggctagtacttggggtttctatag

SEQ ID NO: 178009 - DNA, 631 bp, Homo sapiens
  Payload ID: 14918
  Gene Symbol: RPUSD2
  Gene Name: RNA pseudouridylate synthase domain containing 2
  ENST ID: ENST00000616318
  CDS Start-End: 1-519
ccaatggcagaaacagtgtctacccaggttgggacagagggcgggctgagggcttcgcatcagcaaaacggtgacgctggtggcgacgcgaaggttgagctgtcccccgggcccccgaagccggctggccgggaagtggagccggccccagtaggcggggagcatccctcggctgcagccccaggcccgggcaagcataagaagcggcggggcgcaaccagggagcgtgtcgtgccgcccccgaagaagcggcggaccggggtgagcttcggagatgagcactttgcagaaaccagttattacttcgagggcggcctgcgtaaggtgcggccctattactttgacttccggacctactgcaaaggtcgctgggtgggccacagcttgctgcacgtcttcagtaccgagttccgagctcagcccctggcctactatgaggccgcggtccgggcgggccgcctgcaactcaacgagaagccggtgcaggacctcaacatcgtgctcaaggtggagtcctgatggggctggccagaagcgggcgaggaaaaggggccgggttttgttttgttttgttttgttttttagtcttagtaaagcataggtactggattaaaatcatggcaattctaaa

SEQ ID NO: 178010 - DNA, 1225 bp, Homo sapiens
  Payload ID: 14919
  Gene Symbol: RPUSD3
  Gene Name: RNA pseudouridylate synthase domain containing 3
  Uniprot ID: Q6P087
  ENST ID: ENST00000383820
  CDS Start-End: 3-1058
acatgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 178011 - DNA, 1178 bp, Homo sapiens
  Payload ID: 14919
  Gene Symbol: RPUSD3
  Gene Name: RNA pseudouridylate synthase domain containing 3
  ENST ID: ENST00000433972
  CDS Start-End: 1-456
aatcagcgcgctggctggagcgcgggtctgcccctctggacgcacatgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataataccta

SEQ ID NO: 178012 - DNA, 817 bp, Homo sapiens
  Payload ID: 14919
  Gene Symbol: RPUSD3
  Gene Name: RNA pseudouridylate synthase domain containing 3
  ENST ID: ENST00000451405
  CDS Start-End: 1-110
gggagatggacggccgccgtgttttgggccggttctggagtggctggcggcggggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggacctctagtgacgttgaacaagccacagggtctaccagtgacaggtatgggccggggatgtgggaagggaatgcagcggaagggggtttcgtgactgagggagggaaaagtgaaggcatgaagctttggcctcttgtaatttttctttcttactttccaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcc

SEQ ID NO: 178013 - DNA, 807 bp, Homo sapiens
  Payload ID: 14919
  Gene Symbol: RPUSD3
  Gene Name: RNA pseudouridylate synthase domain containing 3
  ENST ID: ENST00000433555
  CDS Start-End: 1-307
tgttttgggccggttctggagtggctggcggcggggcctgggtgtccgcccagtgcccgaggacgcaggctttggcaccgaagcccggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctc

SEQ ID NO: 178014 - DNA, 1178 bp, Homo sapiens
  Payload ID: 14919
  Gene Symbol: RPUSD3
  Gene Name: RNA pseudouridylate synthase domain containing 3
  Uniprot ID: Q6P087
  ENST ID: ENST00000433535
  CDS Start-End: 1-1011
atgcgcgctgtcctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 178015 - DNA, 907 bp, Homo sapiens
  Payload ID: 14919
  Gene Symbol: RPUSD3
  Gene Name: RNA pseudouridylate synthase domain containing 3
  ENST ID: ENST00000427174
  CDS Start-End: 1-842
acggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcgcttgttcactcttggctggcaccacagacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtcctggatgaagccctcctcagacgcctccacctgaccccct

SEQ ID NO: 178016 - DNA, 756 bp, Homo sapiens
  Payload ID: 14919
  Gene Symbol: RPUSD3
  Gene Name: RNA pseudouridylate synthase domain containing 3
  ENST ID: ENST00000423108
  CDS Start-End: 1-434
gtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtactccagcccacctgcctgctgctttctgaggggtggagggagaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctca

SEQ ID NO: 178017 - DNA, 1005 bp, Homo sapiens
  Payload ID: 14919
  Gene Symbol: RPUSD3
  Gene Name: RNA pseudouridylate synthase domain containing 3
  ENST ID: ENST00000424438
  CDS Start-End: 190-828
ggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttaca

SEQ ID NO: 178018 - DNA, 955 bp, Homo sapiens
  Payload ID: 14919
  Gene Symbol: RPUSD3
  Gene Name: RNA pseudouridylate synthase domain containing 3
  ENST ID: ENST00000418713
  CDS Start-End: 1-741
ctggctcgggagatggacggccgccgtgttttgggccggttctggagtggctggcggcggggcctgggtgtccgcccagtgcccgaggacgcaggctttggcaccgaagcccggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggacctctagtgacgttgaacaagccacagggtctaccagtgacaggaaaaccaggagagctgacgttgttctcagtgctgccagagctgagccagtccctagggctcagggagcaggagcttcaggttgtccgagcatctgggaaagaaagctctgggcttgtactcctctccagctgtccccagacagctagtcgcctccagaagtacttcacccatgcacggagagcccaaaggcccacagccacctactgtgctgtcactgatgggatcccagctgcttctgaggggaagatccaggctgccctgaaactggaacacattgatggggtcaatctcacagttccagtgaaggccccatcccgaaaggacatcctggaaggtgtcaagaagactctcagtcactttcgtgtggtagccacaggctctggctgtgccctggtccagctgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcatg

SEQ ID NO: 178019 - DNA, 2512 bp, Homo sapiens
  Payload ID: 14920
  Gene Symbol: RPUSD4
  Gene Name: RNA pseudouridylate synthase domain containing 4
  Uniprot ID: Q96CM3
  ENST ID: ENST00000298317
  CDS Start-End: 55-1188
attgtagtcgcccttctccacgtggtcttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactgggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcggcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaaatctctgttgtggaagcgtatcttctgttcttaggtctcaggaaggagagggctatactgaacaccattagggatagatggaaatgaccttggcctccctgctcagctggtccatctagtttccaccttgtttcttgcaaacaaatacacctcacactactttttctttctgacagagttggagtgacagcacagttaggggggtacaccccgggacagtctttatatgttccctctgtatagatgatgccactttctagccctttccctgtctccatggtacccattactgtgcataataaatttaactttgaaagcacaga

SEQ ID NO: 178020 - DNA, 2053 bp, Homo sapiens
  Payload ID: 14920
  Gene Symbol: RPUSD4
  Gene Name: RNA pseudouridylate synthase domain containing 4
  Uniprot ID: Q96CM3
  ENST ID: ENST00000533628
  CDS Start-End: 9-1049
cttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactgggccatcactgtgcatgtccccatgccctcagcaggagtcgtggacatccccattgtggagaaggaggcgcaagttgctgtaactcagtaccaggtgctcagcagcactctctcctccgccctcgtggagctccagcccatcactggaataaaacatcagcttcgagttcacttgtcttttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggctgggtgtaaggcagtagcggggagcggcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaaatc

SEQ ID NO: 178021 - DNA, 582 bp, Homo sapiens
  Payload ID: 14920
  Gene Symbol: RPUSD4
  Gene Name: RNA pseudouridylate synthase domain containing 4
  ENST ID: ENST00000532674
  CDS Start-End: 55-582
attgtagtcgcccttctccacgtggtcttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgctcagcagcactctctcctccgccctcgtggagctccagcccatcactggaat

SEQ ID NO: 178022 - DNA, 758 bp, Homo sapiens
  Payload ID: 14921
  Gene Symbol: RCL1
  Gene Name: RNA terminal phosphate cyclase-like 1
  Uniprot ID: Q9Y2P8
  ENST ID: ENST00000381728
  CDS Start-End: 178-741
agtgggcagcctcagacctcagaaggacagcacctgcttggtccaaagggtatgagattcaggactgtttgtctaagctgtctgtggtcaaaagtacattctggactgaagagatggtgatgtaactgggctgtgtgtgtattgaaaaatccctctttgctctttcctcatttcagaatgacatccttaactccaggctgcaggtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataa

SEQ ID NO: 178023 - DNA, 801 bp, Homo sapiens
  Payload ID: 14921
  Gene Symbol: RCL1
  Gene Name: RNA terminal phosphate cyclase-like 1
  Uniprot ID: Q9Y2P8
  ENST ID: ENST00000381730
  CDS Start-End: 41-604
cgtggactgtcttttcagaggcctcgaatagcttgaacaaatgacatccttaactccaggctgcaggtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccaatgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgcca

SEQ ID NO: 178024 - DNA, 804 bp, Homo sapiens
  Payload ID: 14921
  Gene Symbol: RCL1
  Gene Name: RNA terminal phosphate cyclase-like 1
  ENST ID: ENST00000381732
  CDS Start-End: 117-644
cagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagtgagtattgagaacaaaccgtggtgtggtttttgttttgtctcttgtcacaacccaacttgtgagaaaaaagttccttataaggcacagttttattacaaatgtatattgcttttgttatttactttgagatttagaggttaatcactccaggaggcagatgaaccaaaacttaggatcatcaaattcaggactattgttaacagttaccaaggtgccttttgttgttacctaagaaccttcaaaacagatgctctccgtctcatcatagttgacatgaactatagttctgctggctgtatat

SEQ ID NO: 178025 - DNA, 2134 bp, Homo sapiens
  Payload ID: 14921
  Gene Symbol: RCL1
  Gene Name: RNA terminal phosphate cyclase-like 1
  Uniprot ID: Q9Y2P8
  ENST ID: ENST00000381750
  CDS Start-End: 224-1345
gaggcggggaggtggccactggctccgccccgctcccctctgacccggtgtctagtctctccgtcttcctgttccaaaccacgtggacgcgtctgggctgctggaggcagcccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggaacaaccttatattatcagcctggcctcctgtatggtggatctgtggaacatgactgtagcgtccttcgtggcattgggtattacctggagagtcttctttgcttggctccatttatgaagcacccgttaaaaatagttctacgaggagtgaccaatgatcaggttgacccttcagttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccaatgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcgtagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgtttttatattccaggtgtgctgtacattcttattttattttcacaatagctctgtgatgtaagtgctatctccatgagaaaattcataaagggtgttttgttcctttgaaatgtataatgtaaagacattaaatctcctcatttaag

SEQ ID NO: 178026 - DNA, 1459 bp, Homo sapiens
  Payload ID: 14921
  Gene Symbol: RCL1
  Gene Name: RNA terminal phosphate cyclase-like 1
  Uniprot ID: Q9Y2P8
  ENST ID: ENST00000448872
  CDS Start-End: 96-659
ggattacagaggtaaagcccttgcccttatagagtgtgtggtctcattgaagagcaagaacaaaatgtgcatatgtgaagagagatgtatgcagaatgacatccttaactccaggctgcaggtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccaatgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcgtagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcattgtatttatatgtgagggatggatggctgcggggctccaagtaagttattgggatgtttttatattccaggtgtgctgtacattcttattttattttcacaatagctctgtgatgtaagtgctatctccatgagaaaattcataaagggtgttttgttcctttgaaatgtataatgtaaagacattaaatctcctcatttaaggatctaagtgt

SEQ ID NO: 178027 - DNA, 1644 bp, Homo sapiens
  Payload ID: 14921
  Gene Symbol: RCL1
  Gene Name: RNA terminal phosphate cyclase-like 1
  ENST ID: ENST00000442869
  CDS Start-End: 411-1058
ccgagccgccgccgtcggtgtcgccgccaccaccaccatcggagtcacgagtcccgcgtctgtccgaagtcgccgctctcgggctgctcacgtctcttcggagagcgcgcacatggcgactcaggcgcactccctcagctacgcagggtgcaacttcttgcgccaacgtctggtcctgtctaccctgagcgggcgccccgtcaaaatccgaaagattcgggccagagacgacaacccgggcctccgagattttgaagccagcttcataaggctattggacaaaataacgaatggttctcgaattgaaataaaccaaacaggttgatgttcttaaggcaacagcactccctttgttgaaacaatttgggattgatggtgaatcatttgaactgaagattgtgcgacggggaatgcctcccggaggaggaggcgaagtggttttctcatgtcctgtgaggaaggtcttgaagcccattcaactcacagatccaggaaaaatcaaacgtattagaggaatggcgtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacacgatagaatttttgcggcatttgaagagctttttccagattatgtttaaaattgaaaccaagccatgtggtgaagaactcaagggtggggataaagtgctgatgacctgtgttggcattggtttctccaaccttagcaagaccctcaagtgataaccatcacaagataaggccccaatgcctacagacaaagcagaagctgccacggacaccaatgggaccaagtccaaatggattaatccaggacagaatagccacttgcttaattttctgtgaagaaatatcaatatacaaataaaagacatccctgtagcatatggtttccagctgtttctccagtggcattgccattgcccaggaggggcccagtcaccatgagagctcccttgccttacctggaggaagaatgtgccttcaggccacagtcgtgctgctagaacagtctcgtagctgcagttcagctgtgcttcctcagcctactatcataggcttcctcagccctctgtcatatggctgttttgcaaacctgtggagtctgttactgttctttctgcaaggactcacctccttgagccttggtttttgttgtagggattaaatgagataatatgagtggcagctcttcatgagtcctgcagtgctaagcaaatgtcagaaattggtgtattagactatttatctttgatcttctgaatggattgctgtcatggacacggacacggatcttcatctggttcat

SEQ ID NO: 178028 - DNA, 497 bp, Homo sapiens
  Payload ID: 14921
  Gene Symbol: RCL1
  Gene Name: RNA terminal phosphate cyclase-like 1
  ENST ID: ENST00000441844
  CDS Start-End: 85-497
gaggtaaagcccttgcccttatagagtgtgtggtctcattgaagagcaagaacaaaatgtgcatatgtgaagagagatgtatgaatgacatccttaactccaggctgcaggtactctgtacgtgtgtcacctcagatggcgaaccggattgtggattctgcaaggagcatcctcaacaagttcatacctgatatctatatttacacagatcacatgaaaggagtcaactctgggaagtctccgggctttgggttgtcactggttgctgagaccaccagtggcaccttcctcagtgctgaactggcctccaacccccagggccagggagcagcagtacttccagaggaccttggcaggaactgtgcccggctgctgctggaggaaatctacaggggtggatgcgtagactcgaccaaccaaagcctggcgctactactcatgacccttggacagcaggatgtttccaaagtcctgctaggccctctctctccctacac

SEQ ID NO: 178029 - DNA, 1872 bp, Homo sapiens
  Payload ID: 14922
  Gene Symbol: RNPC3
  Gene Name: RNA-binding region (RNP1, RRM) containing 3
  Uniprot ID: Q96LT9
  ENST ID: ENST00000423855
  CDS Start-End: 101-1654
tagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaa

SEQ ID NO: 178030 - DNA, 686 bp, Homo sapiens
  Payload ID: 14922
  Gene Symbol: RNPC3
  Gene Name: RNA-binding region (RNP1, RRM) containing 3
  ENST ID: ENST00000531883
  CDS Start-End: 132-686
gcgcagtcgtgagtcctcttgtccttgagcgtcaaccttctttccctgaagtggctggggttcctgtttccttctttgattgacaacttgtgttaaccctcgcacatctctgggccaatttttgcttgaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacag

SEQ ID NO: 178031 - DNA, 3641 bp, Homo sapiens
  Payload ID: 14922
  Gene Symbol: RNPC3
  Gene Name: RNA-binding region (RNP1, RRM) containing 3
  Uniprot ID: Q96LT9
  ENST ID: ENST00000533099
  CDS Start-End: 237-1790
gcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatcctttttggggcagtgtttttttgtttttttcctagaaatgtttgtccttcccccacctgttgatccaggttaaggaatacttttttacactttattcaaatgaaatatttctaaaattatttgtatagactgaacagatcttttatgtgtttttagatttgttgttgaattttctgtgctgtcctttatataattttttgagggaaagttagtgaatcaggtcaacttacttagagaatgtgttcatttactttaacccagaatacagtcttgtttcttctatttgtatgtttcctaaacctaattcaataacatatgctttctgttgtgtaatatatctggtttaggtatttataatgtgtttaaaatttgggcaaaggaaatgtttttcttttaaaaagtacttacattgaaaattaagatgtctggattactatgtaaattctagagagtagcagacctctcatctgaagtcttagtgaatctcttttgacatagatagcaatagaagtatctttcttctttcccctttctttttctaaacaagagaagaaaagcgtaatagaggggagaacacataatgcccactaagggtagtgcattaaggaaaaacagtcttggcaggtatataggaatagtggtttccagactggttgatgaccgtaatcaccaagaacagtggttctcagtcttggctgcacattgcagtgatctggaacttaaatactaattttaaaagggtgcagtggctcatacctgtaatcccagcactttgcaagtccgagatgggagaatcacttgagcccaggagtttgagaccagcctgggcaatgtagggagaccctgtccctacaaaaaatacaaaaattagccaagtgtggtggcttgcacctctggtctcagctacttgggatgctaaggcaggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtg

SEQ ID NO: 178032 - DNA, 237 bp, Homo sapiens
  Payload ID: 14922
  Gene Symbol: RNPC3
  Gene Name: RNA-binding region (RNP1, RRM) containing 3
  ENST ID: ENST00000532117
  CDS Start-End: 1-57
tttgctcgatctgctagaccaaaacaagatcctaaggaaggaaaaagaaagtgttaaaaattaataaagaagcattcctgcgtaaatactgctgtaatactgtcatgcaaagtgtatcctttcttgtctcttgtttcttctatttgtatgtttcctaaacctaattcaataacatatgctttctgttgtgtaatatatctggtttaggtatttataatgtgtttaaaatttgggcaa

SEQ ID NO: 178033 - DNA, 547 bp, Homo sapiens
  Payload ID: 14922
  Gene Symbol: RNPC3
  Gene Name: RNA-binding region (RNP1, RRM) containing 3
  ENST ID: ENST00000524641
  CDS Start-End: 1-547
taatggaactagcaaatcttcagcccaaaagacctaaaacaataaagcagcgccatgtgagaaaaaagagaaaaataaaggatatgttgaatacacctttgtgtccttcacacagcagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcat

SEQ ID NO: 178034 - DNA, 768 bp, Homo sapiens
  Payload ID: 14922
  Gene Symbol: RNPC3
  Gene Name: RNA-binding region (RNP1, RRM) containing 3
  ENST ID: ENST00000527062
  CDS Start-End: 353-768
ttcctgtttccttctttgattgacaacttgtgttaaccctcgcacatctctgggccaatttttgcttaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacag

SEQ ID NO: 178035 - DNA, 2013 bp, Homo sapiens
  Payload ID: 14922
  Gene Symbol: RNPC3
  Gene Name: RNA-binding region (RNP1, RRM) containing 3
  Uniprot ID: Q96LT9
  ENST ID: ENST00000524631
  CDS Start-End: 381-1931
gcacatgcgcagtcgtgagtcctcttgtccttgagcgtcaaccttctttccctgaagtggctggggttcctgtttccttctttgattgacaacttgtgttaaccctcgcacatctctgggccaatttttgcttgtaagtctttccggagacccctggaatttaaatcattagcaccgcgcccttccccgaagagtcttcgaagggttgccgcttttcggtggcgcagttctcgcgagaaggtgactttctttctcggtatttcctggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgctgaagtacttcggggctcagtctgtgcgggtcctgtcagataaggggcgactgaaacatacagcttttgccacattccctaatgaaaaagcagctataaaggcattgacaagactccatcaactgaaacttttaggtcatactttagtcgttgaatttgcaaaagagcaagatcgagttcactccccatgtcccacttcaggctctgaaaaaaaaaaaaggtctgatgaccctgtcgaagatgataaagaaaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcccacaccttttggaccaattactgcgcgacctcccatgtatgaagactatatgccattgcatgcacctcttccacccacatctcctcagccacctgaggaacctcctttgccagacgaggatgaggaattatctagtgaagaatcagaatatgaaagcactgatgatgaggaccgacagagaatgaacaaattaatggaactagcaaatcttcagcccaaaagacctaaaacaataaagcagcgccatgtgagaaaaaagagaaaaataaaggatatgttgaatacacctttgtgtccttcacacagtttacatccagtgctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatgatttacctgctactgaagttgatgcatccaatataggatttggaaaaatcttccccaaacctaatttggacatcacagaggagattaaagaagactctgatgaaatgccttcagaatgtatttctagaagggaattggaaaagggcagaatttctagagaagaaatggaaacactttcagttttcagaagttatgaaccgggtgaaccaaactgtagaatttatgtaaagaatttagctaaacatgttcaagaaaaggaccttaaatatatttttggaagatatgttgacttttcatcagaaacacagcggatcatgtttgatatacgtttgatgaaagaaggtcgtatgaaaggacaagctttcattggacttcctaatgaaaaagcagcagcaaaagccttaaaggaagctaatggatatgtgctttttggaaaacccatggtggttcagtttgctcgatctgctagaccaaaacaagatcctaaggaaggaaaaagaaagtgttaaaaattaataaagaagcattcctgcgtaaatactgctgtaatactgtcatgcaaagtgtatcctttcttgtcgtatccttttt

SEQ ID NO: 178036 - DNA, 784 bp, Homo sapiens
  Payload ID: 14923
  Gene Symbol: RNASEK-C17orf49
  Gene Name: RNASEK-C17orf49 readthrough
  ENST ID: ENST00000547302
  CDS Start-End: 1-701
aagattttgagaatggcccccagaacatatacaacctttacgagcaagtcagctacaactgtttcatcgctgcaggcctttacctcctcctcggaggcttctctttctgccaagttcggctcaataagcgcaaggaatacatggtcggagagatcttctcggcggccggcgccgccttcacgaagctcggggagctgacgatgcagctgcatcccgtggccgactcttctcctgcgggtgcgaagtggacggagacggaaatagagatgctgagggctgctgtgaagcgatttggggacgatcttaatcacatcagctgtgtcatcaaggaacggacagtggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctgatgtgacactcagtgctctgaacgactccgatgccaacagtgacgtggtggatattgaagggctaggagaaactcctccagctaagaaactcaacttcgaccaggacagcctgaccctggattctggccttctcatgacctctgctgatcctcctctcctctcctgctgagccttccacctctgacctctcactgttcatgccggacctgtggatctcctgggactccgagcaaggcctgcacgagagagggc

SEQ ID NO: 178037 - DNA, 805 bp, Homo sapiens
  Payload ID: 14924
  Gene Symbol: RNF103-CHMP3
  Gene Name: RNF103-CHMP3 readthrough
  ENST ID: ENST00000440757
  CDS Start-End: 143-805
ggccggccagtgacggcgccgggtggcccgcgcgtggacacggggccctcgcccaagctgccaccgagccgcggcccccgccctcgacccttctctctcccgtattccgagctctctggaaagagaggaaactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatg

SEQ ID NO: 178038 - DNA, 1135 bp, Homo sapiens
  Payload ID: 14924
  Gene Symbol: RNF103-CHMP3
  Gene Name: RNF103-CHMP3 readthrough
  ENST ID: ENST00000604011
  CDS Start-End: 244-999
actcgggggtcggcagtttgcaggtgcgatgggcggccccctcacccacgtttatccggactggagcccgccgctcccggctgggtttccgggtggttcgcgctccttctgaattggcagcgaggtcgcggcaggttcgaggctttgacaccagcacctctctatgaagaaaagagtgtgttgtgaacgaagtcagaatttcctgtgttccctttgccgctcctggagttcactggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccag

SEQ ID NO: 178039 - DNA, 1735 bp, Homo sapiens
  Payload ID: 14925
  Gene Symbol: ROGDI
  Gene Name: rogdi homolog
  Uniprot ID: Q9GZN7
  ENST ID: ENST00000322048
  CDS Start-End: 380-1243
tcctgggggcgccccgggagctccgcccccaagcgggcgccccaggctggtgccggccgcgtccctggccagccggagcaagcctgactcgtgcagccgccggccgcgtccctggccaggcggagcgagcctcactcccgcagccgccagtctggttccagggctcccgcaggtttcgggggccgaggcggaccgacaggcgccagccaatcgcgagcacggagccggcctgggggcggggtggtacccgctccgccaatcgggtgggggcggagccagacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcca

SEQ ID NO: 178040 - DNA, 457 bp, Homo sapiens
  Payload ID: 14925
  Gene Symbol: ROGDI
  Gene Name: rogdi homolog
  ENST ID: ENST00000586153
  CDS Start-End: 1-366
gatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgtttggggctctcagcgcctggaggtgagccacgtgcacaaagtggagtgcgtgatcccctggctcaacgacgccctggtctacttcaccgtctccctgcagctctgccagcagctcaa

SEQ ID NO: 178041 - DNA, 651 bp, Homo sapiens
  Payload ID: 14925
  Gene Symbol: ROGDI
  Gene Name: rogdi homolog
  ENST ID: ENST00000586504
  CDS Start-End: 1-651
tgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcataccca

SEQ ID NO: 178042 - DNA, 1362 bp, Homo sapiens
  Payload ID: 14925
  Gene Symbol: ROGDI
  Gene Name: rogdi homolog
  ENST ID: ENST00000587843
  CDS Start-End: 63-269
agaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtgggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaataaagatcatcagactcc

SEQ ID NO: 178043 - DNA, 1530 bp, Homo sapiens
  Payload ID: 14925
  Gene Symbol: ROGDI
  Gene Name: rogdi homolog
  ENST ID: ENST00000588201
  CDS Start-End: 103-462
agacgccgggggcggacgggaggaccggaggaccgaggacagaaagattggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggtgagtcccccggccctgtcccctcccatcctgccaatggggaagagcatgggagctcccactttctctctgtacaagccctgcgactctgggcgggacccttgatctctctggcctcagttttctcctttggaaaatgacagcaaccctcacaccttctcccgggatcggtgtgcagattcagtaagaggtgcaggagaggggttctttgcacacggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaaggtccctgctgccgggtttcgggacctgggaacagtagccactgggctgggtgggagtgggagctaccatgtctgttgttccttaatgcatggggacacgggaggacgcagagccaaccccgcctctccctgcagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggagg

SEQ ID NO: 178044 - DNA, 570 bp, Homo sapiens
  Payload ID: 14925
  Gene Symbol: ROGDI
  Gene Name: rogdi homolog
  ENST ID: ENST00000587711
  CDS Start-End: 57-570
attggtggacaggagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaaggtgggcc

SEQ ID NO: 178045 - DNA, 811 bp, Homo sapiens
  Payload ID: 14925
  Gene Symbol: ROGDI
  Gene Name: rogdi homolog
  ENST ID: ENST00000591392
  CDS Start-End: 51-811
ggacaggagcagcggccggtggggagggcgctcggcggcggcctgcggccatggccaccgtgatggcagcgacggcggcggagcgggcggtgctggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgaggtcctcaagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaaggtgggcccggg

SEQ ID NO: 178046 - DNA, 371 bp, Homo sapiens
  Payload ID: 14925
  Gene Symbol: ROGDI
  Gene Name: rogdi homolog
  ENST ID: ENST00000592019
  CDS Start-End: 1-220
caaccagctgctgcacttcgccttccgggaggacaagcagtggaagctgcagcagatccaggatgccagaaaccatgtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatgg

SEQ ID NO: 178047 - DNA, 1394 bp, Homo sapiens
  Payload ID: 14925
  Gene Symbol: ROGDI
  Gene Name: rogdi homolog
  ENST ID: ENST00000587377
  CDS Start-End: 45-737
gagcagcggccggtggggagggcgctcggcggcggcctgcggccatggccaccgtgatggcagcgacggcggcggagcgggcggtgctggaggaggagttccgctggctgctgcacgacgaggtgcacgctgtgttgaagcagctgcaggacatcctcaaggaggcctctctgcgcttcactctgccgggctccggcactgaggggcccgccaagcaagagaacttcatcctaggcagctgtggcacagaccaggtgaagggtgtgctgactctgcagggggatgccctcagccaggcggatgtgaacctgaagatgccccggaacaaccagctgctgcacttcgccttccgggaggacaagcagtggaagctgcagcagatccaggatgccagaaaccatgtgagccaagccatttacctgcttaccagccgggaccagagctaccagttcaagacgggcgctgagccaaccccgcctctccctgcagctgatggacgcagtgatgctgcagctgaccagagcccgaaaccggctcaccacccccgccaccctcaccctccccgagatcgccgccagcggcctcacgcggatgttcgcccctgccctgccgtccgacctgctggtcaacgtctacatcaacctcaacaagctctgcctcacggtgtaccagctgcatgccctgcagcccaactccaccaagaacttccgcccagctgggggcgcggtgctgcatagccctggggccatgttcgagtggggctctcagcgcctggaggtgagccacgtgcacaaagtggagtgcgtgatcccctggctcaacgacgccctggtctacttcaccgtctccctgcagctctgccagcagctcaaggacaagatctccgtgttctccagctactggagctacagacccttctgatcacagcacccaggagcttgtctccaggaaggcggccccgtcccctactcatacccaccacagagcaccagccagtgccaacgccaggctgctatttatctccctatcccaccccctaccccacctaacacatttgcactgccgggaatggacactggaagtgccaggaggaaggaaggctggtttggtggggtagtggggaggtcagggaggcggggccaagggtgtcccacattcccaacaccgccctctgatcaccatgggaatctttggactcaggacagggccaggcgcagggctctccctcctctccccttcgctgtcccctccccctggagggcatggtgtcggggggtggcactgagctatgagtcccggggatggtgaggaacgccacagacagagccaccctaggagtgagtatagtgctggtgactgtgtttcatagccccagtccagggctgtctaagaaa

SEQ ID NO: 178048 - DNA, 7417 bp, Homo sapiens
  Payload ID: 14926
  Gene Symbol: ROS1
  Gene Name: ROS proto-oncogene 1 , receptor tyrosine kinase
  ENST ID: ENST00000368507
  CDS Start-End: 200-7225
caagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtaatgatacttatgccaccgtttgtgagcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccagcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcctgatttctaatcttggttctgagagccatttggtttcagttgtagcaatccccataccagctgcctg

SEQ ID NO: 178049 - DNA, 7435 bp, Homo sapiens
  Payload ID: 14926
  Gene Symbol: ROS1
  Gene Name: ROS proto-oncogene 1 , receptor tyrosine kinase
  Uniprot ID: P08922
  ENST ID: ENST00000368508
  CDS Start-End: 200-7243
caagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcctgatttctaatcttggttctgagagccatttggtttcagttgtagcaatccccataccagctgcctg

SEQ ID NO: 178050 - DNA, 681 bp, Homo sapiens
  Payload ID: 14926
  Gene Symbol: ROS1
  Gene Name: ROS proto-oncogene 1 , receptor tyrosine kinase
  ENST ID: ENST00000403284
  CDS Start-End: 1-294
tggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagggactgaaaacacaccgtcgatgaaaaccagccactgatgaacagcctcagacctggccagtacggggagcacgtgaaccataactggcttagaaggactgatttcatgccaacttgaggggagaattccaaattccaaagacactcctctcacaggactatgaaaccatcttttaagaagttccaaggacaaaagtcacttccataattatagtcctggcaacttgatctttagatctatttttgcttcatctggctctggcattcccataaccttaaaaaatgttcctgttcatactagagaattcccttggcccttatttctaattgaaacctccttgaagtttctgttgctgcttttcatgcagagtgaaatacattctaacctgcagaa
